United States Patent 9,572,897 (MODIFIED POLYNUCLEOTIDES FOR THE PRODUCTION OF CYTOPLASMIC AND CYTOSKELETAL PROTEINS) - sequence listing, part 2

SEQ ID NO: 454 - DNA, 6451 bp, Homo sapiens
gggttagttcctgttaggccccggccgggggagtaggttgaagtctcctaagatgcccggtgggctggggcaccgggagctgtgaagggaacgtgagggggcggcgtagtggagacccacggcaggcctgaagaagagcggcggccgagcccgccttccctgcaccatgctcatagaggatgtggatgccctcaagtcctggctggccaagttactggagccgatatgtgatgctgatccttcagccttagccaactatgttgtagcactggtcaagaaggacaaacctgagaaagaattaaaagccttttgtgctgatcaacttgatgtctttttacaaaaagaaacttcaggttttgtggacaaactatttgaaagtctctatactaagaactaccttccacttttggaaccagtaaagcctgagccaaaaccactagtccaagaaaaagaagaaattaaagaagaggtatttcaggagccagcagaggaagaacgagatggcagaaaaaagaaatatcctagtccccagaagactcgttcagaatctagtgaacgaaggacacgtgagaaaaaaagagaagacgggaaatggagagactatgaccggtactatgagcggaatgaattgtaccgtgagaagtatgactggagaagaggcaggagtaagagtcggagtaagagtcgaggcctgagtcgcagtagaagccgaagtagggggcgcagcaaagaccgggatccaaataggaatgttgagcacagggaaagatcgaagtttaagagtgaaaggaatgacctggagagttcctatgtgcctgtgtctgcaccacctccaaactcttctgagcagtattcctctggggcacagtctattcccagcactgttactgtgatcgcacctgctcaccactctgaaaacacaactgagagttggtctaattactataacaatcatagctcttccaattcttttggtcgaaacctaccaccaaagaggcgatgcagagattatgatgaaagaggattttgtgtacttggtgacctttgtcagtttgatcatggaaatgatcccctagttgttgatgaagttgctctgccaagtatgattcctttcccaccccctcctcctgggcttcctcctccaccacctcctggaatgttaatgcctccaatgccaggtccaggcccaggcccgggcccaggtccaggcccaggcccgggcccaggtccaggtcctggccatagtatgagacttcctgttccccaaggacatggtcagcctccaccatccgttgtgcttcccataccaagaccacctataacacaatcaagcttgataaacagccgtgaccagcctgggacaagtgcagtgcccaatcttgcatcagtgggaacaagactacctcctcctttaccccagaacctcctttacacagtatcagaacgacagcccatgtactctcgtgaacatggtgctgctgcatctgagcgacttcagttggggacaccgcctcctctgttggcagctcgtttggtgccacctcgaaacctcatgggatcctccattggataccatacctcagtctccagccctacccctctggttccagatacatatgaaccagatggttacaacccagaagctcctagtattactagttctggtagatctcagtacagacagttcttttcaagaactcagacacagcgtcccaatctgattggcctaacatctggagatatggatgtaaatccaagagctgctaacattgtgatccagactgaaccaccagttcctgtttcgattaatagcaacataaccagagtagttcttgaaccagatagtcgaaaaagagctatgagtggtttggaagggccactcacaaagaaaccttggctgggaaagcaaggaaataacaatcaaaataaaccagggttcttacgaaagaatcagtatacaaacaccaaattagaagtcaagaaaatccctcaggaattgaacaacattaccaagctcaatgaacacttcagcaaatttggaactattgttaatatccaggttgcttttaagggtgacccagaagcagccctaatccaatatcttaccaatgaggaggccaggaaagccatttctagcacagaagcagttctaaacaaccgattcattcgagtcttgtggcatagggaaaataatgagcaaccgacactacagtcctcagcacagctgctcctgcaacaacagcaaacacttagtcacctctcacagcagcaccatcacctgccacagcatctacatcagcagcaggtgctagtggcccagtctgctccttcaacagtgcacggaggtatccagaagatgatgagcaaaccacagacatcaggtgcatatgttcttaacaaagttcctgttaaacatcgtcttggacatgcaggtggtaaccagagtgatgcatcacatttgttgaatcagtctggtggtgctggagaagattgccagatattttcaactccaggccatccaaaaatgatttacagctcctcaaacttaaagacaccttcaaagctctgttcagggtctaaatctcatgatgttcaagaagtgcttaaaaaaaaacaggaagcaatgaagttacaacaagatatgaggaaaaaaagacaggaagtgttagaaaagcaaatagaatgccaaaagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggcccagaaggagttattagatactgaactggacctccacaagaggctgtcctcaggagaagacaccacagaattacggaaaaaactcagtcagttacaggttgaggctgcacggttaggtattttacctgtgggtcgaggaaagaccatgtcctctcaaggtcgaggaagaggccgagggcgtggaggaagaggaaggggctcactaaatcacatggtggtggaccatcgtcccaaagcactaacagttggaggattcattgaggaagaaaaagaagacttgcttcagcatttctcaaccgcaaaccaagggccaaaatttaaagaccgtcggctacagatatcatggcacaagcccaaggtaccatctatatccactgagactgaagaagaagaagtcaaggaggaggaaacagaaacctcagatttgtttttgcctgatgatgacgatgaagatgaagatgaatatgagtctcgctcatggcgaagatgaaatctgatgctagctgtataatttttaggaatattgtttagaagaacaacttttaaaaattatttaaaagaagtcaatgagccaaaaaaaatttttttatttttcttttcaacacagtaggttcaagaacagcaagtttgctatttaaacacatctcataactgtacatgatattaaagcaccaaaggcctagtgacttttacacagttgtgaagatccacagcaatgacatggataatctctagagccttattttccacaccaccttttttttgttgctgttggtgttggattatgatgtaaatgacagggtgttcagaaattttattttggattataatctactgataaaatttaattaaatgtcaaaatcacctgtaatcttttaactctcagttgttatggatgggtcatcagacagtaggaaatatttgtaattaaaatacccttttgctttcaagagtggtcttggaagaaaaatatgtttattttaattttaatttttttttttttttactttggaggagcccaatttgtattcagtctaaatttgtttttcatggtttttatgtgtggtagtactagttcagtgaaaatcacaacaaactgtgtgttcttaaatgctacagcaatggtagctagctctatagtatttccattctcttgtcatatgaactcctggacttttcctgctactgattcttagtttgctttgatatttagtgagcgctggttcggctggtctttttaaaaatttttataactcagaatgtaaaaggctttcacctattgcccctttctcgtcccccttttcttcctcttgcctttctattaataggcctgacttagtcatcattgatataagtggttcatttgggcaaccgcaggcagtctccaataaaaggttcaaaccagcacctggataaataagtgatgttttgatgagaatgatggaaggattttggggagaagagaatcaccagctttattttttccctcttttgaagcttcagttcagtatagttacacagaagggtttaaaaatgtctgaaattcttttcctaaatttaaaccatgatggtgaggtgactggggggtggggggtggaggtgggagggggttgagggctgagtatgctagtaataaatgggagtcatatatgactttgttcagatgaccttattttttcataattttgtagcttgttgctatccatgaacatacgcatccctcagtagacagtttcctttactgtgtgcatttttactgtacactgtatagagtagagtatctgttaagtaaaatatatatgtaaatttatgtcttcgtgttctgaatgttagatggaaaagcagaggagcaacactacactgtactgacccctgggaaaataaaatgattaatgtacctaggctgtcactttttcaaggatatacacatctgtgtttttatatatgtgtggtatgaaaatttgaaacctcctgttgtctccaaaagggtcttggtgaccactatatcaaggattttgtttgctgaggtaaagacaatttctcaatatagaaactattcactaagaacttaaaaccatcaggattctagatttacttagctataagaagttaaatcccacgttctgataatctttattcttctacatgttttcctggaatgatgtgtcaaaccagggtcatttttaagttcatataattttctttcataataatgaggacttcctttttctaggttattgttatatttctagtaacactgaaggtaaaataagcttataaaagaaggaaaacatcagaatggtgtatctagaatacacaatcttgctccttactcctccatcatctctaatgaaatttttcttgatgtctgtggctcagtcagtatatattttgaaagattcattgtggtgaatattttgagtcctgacagtttaaacgtgatagagggaacaaaggatttatatattttttgtacaaagttttttcttaaactgtataattttgtaaataatttgtttgggttttttttttgtgtactaaaactaccagcgtatagatttcaataagaattgttgtatttttgtatttggaaactgaaaattacagtaaataaatggaactctaagaaaaatttcagtagacagttcaacagaatgagattccttttcatatgatttttttgacctcaaaatggacatcttatttcactctcagtaaaaagttgaaaatttgactttttagtattgggggcagaagatagaagtgtgttaaagtgaaaaacagttttttcagtaaggtttgaggccctttctataagttttcagtacaccttaaacaggactaaaaatactttaaaagtgtgctttcaaagaattttaaaacatgtttgactcaaagatgaatttgaagtgagttaattataatactggaaaacttcaggttagcataaaatagtttatatatatcccctgccccctttgggatttacttccaccatcaaatcttcaactgttagaatttcacttaaaagtgaataactgccatacatgttttcttggcatcttcatttacagaaataacatacagcatctaaagcaagttctgtccctcttaatgtgtatgacatctttttaagtagctgatcagcaataatagccaccagttgactaggtcagcctgatatactagtggatcactgtccaagataaaaaggtaaccccaagtattgcaaaatttccctcaatttctttatgtaacattgaagaaatgttgttaccagctaagatgataaattggaaaacagtcttgttaaggtgaaaggggtccttggtgatggatcattatttcaaaaaagaaaaaaatcatgtgaaaaggaatagtggttcctcttgatgtatagtatgcctgtattatagtttttacaaaattgtgaacttgtgtaatagtataataggagatattgttgaatttctaactgtttatacatttaaattcatatatgtaatgtttgttttatcaattacaatctgaatttctaagaagcatgttgacttttgcaataaagatgcaatatggaatggttcacaattgg

SEQ ID NO: 455 - DNA, 2668 bp, Homo sapiens
acatgcgcagtagctgtaggagggggtgggcgctccattgggcgtttctcttggtttttcctttccgcgcggcttgggcggacgtctcgtgagacgtgggacttctcgcgggaactgcattcaaatatcccaggcgcttactcgagagctagctgagcgaatgggccggcgactgtggagttagcgtcctcaatgtggacgccctgagctcccattaggagccgctggctgcggcagcaggggactagcgtgagagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatcagaaggaactcctctcttgtaaatcagaggaactgcgcgtaatgtctgaacgtgtgcaggaaagcatgtcttcagagatgctggctcttcaaattgagctgacagaaatggagagtatgaagaccaccctcaaagaagaagtgaatgaactacaatacagacaagaacagctagaacttcttattactaacctaatgcgccaggtagaccggcttaaagaggaaaaagaggagcgagagaaagaagcagtttcttactataatgccctagagaaagctcgtgtagcaaatcaagatcttcaggtacagttggaccaggcactccagcaagccttggatcccaatagtaaaggcaactctttgtttgcagaggtggaagatcgaagggcagcaatggaacgtcagctcatcagtatgaaagtcaagtatcagtcactaaagaagcaaaatgtatttaacagagaacagatgcagagaatgaagttacaaattgccacgttgctacagatgaaagggtctcaaactgaatttgagcagcaggaacggttgcttgccatgttggagcagaagaatggtgaaataaaacatcttttaggtgaaattagaaatctggagaaatttaagaatttatatgacagtatggaatctaagccttcagtcgactctggtactctggaagataacacctattatacagatttacttcagatgaagctggataacttaaacaaagaaattgaaagcactaaaggtgaattgtccatacagcgaatgaaagcattatttgagagccagcgggctctagatattgagcgaaaactttttgcaaatgaaagatgcctccagctttcagaaagtgaaaatatgaaactgagagctaaactagatgaattgaaactaaaatatgaacctgaagagacagttgaagtgcctgtactgaaaaagaggcgtgaggtgctccctgtggatataaccaccgctaaagatgcatgtgtcaacaacagtgctctcgggggagaagtttatcgattaccgcctcagaaagaggagacacagtcctgccctaacagtttagaagataacaacttgcaattagaaaaatcagtttctatatacacaccagtagtcagtctctctcctcacaaaaatctgcccgtggatatgcagctgaagaaggaaaagaaatgtgtgaaactcataggagttcccgctgacgctgaggccttaagtgaaagaagtggaaacacccctaactctcccaggttagctgctgaatcaaagcttcaaacagaagttaaagaaggaaaagaaacttcaagcaaattggaaaaagaaacttgtaagaaattacaccctattctatatgtgtcttctaaatctactccagagacccagtgccctcaacagtaaagacttgtctttaataagagtacggtgccacttgcctcaaaagttactatggtgcttaagattgtcttgatctgacatatatcaccttctgggttatttactcattgtgccaggacctggcattttcatgtgcctttgaccaagtgttcagaatttgcttgactctaacctggagagcttcttaagtgatgccccttcatggagcttctatgacagtgaataaactattaattgaaggaaaatgttataattaatgtatctatttgctgcattgtatatggattaaatgataaaaaacaagtaatctaccctcagagccatgtatttgagaatgcttcaatcatattttcctatgtacttttttttataaacttagttttagactatgttgtaaaaatgggaaggttgtaaactatgttgtaaaaataggaaatgtggcttaaaatatatacattatattgtttcaggattttgtcagtgtttaaagaaccaatgttcatctttgtatttatatacatgatttaaattttgtctaaaattttaaataaaactgcagtgatttatccttaaa

SEQ ID NO: 456 - DNA, 1511 bp, Homo sapiens
aacagttgccttttcctctcacagaaggaagatttcattttgtttgagacgagaaaccaaaccacacaccaaagagaggggtatgatggctaagaagcccccaaaaccagcccctcgcaggatcttccaggaaaggttaaagattactgctctacctttgtactttgaaggttttttattaatcaagcggtcaggataccgggagtatgagcattactggacagagttgagaggaactactcttttcttttataccgacaaaaagagtataatatatgttgacaaattagacatagtagacctcacatgccttactgagcagaattcaactgaaaagaactgtgcgaaattcacccttgttttgccgaaagaggaagtacaactgaagacagagaacacagaaagtggggaagaatggagaggcttcattcttacagtaacagagctgtcagttccccaaaacgtgtcactcctacctgggcaagtaattaaactgcatgaagtcctagagagagaaaagaaaaggaggattgagacagagcagagtacgtccgtggaaaaagagaaggaaccaactgaagattatgtggatgtactgaaccctatgccagcatgtttttatacagtgtcccggaaagaggcaactgagatgctccagaagaacccttctttgggaaatatgatcctgaggcctggtagtgacagtagaaactactccatcactattcggcaggagatagacattccaagaatcaagcactacaaagtgatgagcgtaggacaaaactacactattgaactggaaaaacctgtaacactcccaaaccttttcagtgtcattgattattttgtgaaggagactcgaggaaatttaagaccatttatatgttcaactgatgaaaacactggtcaagaacccagtatggaagggagaagtgaaaagttgaagaaaaatccacacattgcatgaaatacaatgtgaaagctcctttgtatatcttggtaatttatattttcaaaacgaagttcttacttttaaagagaattacctatattctcctgatactgattaccaagtcattcacctgaacaccagaattagaattaaacattgtaccatacaatttcattatcttatcagaatgaaaccaattcacagggaaactagagactacggctgtggtggtaacctgcagatatacacattcccatgcactgacataagttgaaaacacatagtactttctagatggaatttttttctttaggcctcaatgaaatacatttcccctatataattccaacagcagtttctctagttctaaattttaccaattcccaaaaaacctaagttttgctgaaatctgatttgaccaatttatcaaatatgtcattttaattacctagctggaagttagagacatgaaatgtactagaggagcccttttccaatggaaatattatataccacattttttgttaatggaaataaatgtcttcattcccatgtt

SEQ ID NO: 457 - DNA, 6234 bp, Homo sapiens
atgtttcatatctgcccagcagagaatctgtaccagaacaggtttttaggcctggccgccatggcgtctccttctagaaactcccagagccgacgccggtgcaaggagccgctccgatacagctacaaccccgaccagttccacaacatggacctcaggggcggcccccacgatggcgtcaccattccccgctccaccagcgacactgacctggtcacctcggacagccgctccacgctcatggtcagcagctcctactattccatcgggcactctcaggacctggtcatccactgggacataaaggaggaagtggacgctggggactggattggcatgtacctcattgatgaggtcttgtccgaaaactttctggactataaaaaccgtggagtcaatggttctcatcggggccagatcatctggaagatcgatgccagctcgtactttgtggaacctgaaactaagatctgcttcaaatactaccatggagtgagtggggccctgcgagcaaccacccccagtgtcacggtcaaaaactcggcagctcctatttttaaaagcattggtgctgatgagaccgtccaaggacaaggaagtcggaggctgatcagcttctctctctcagatttccaagccatggggttgaagaaagggatgtttttcaacccagacccttatctgaagatttccattcagcctgggaaacacagcatcttccccgccctccctcaccatggacaggagaggagatccaagatcataggcaacaccgtgaaccccatctggcaggccgagcaattcagttttgtgtccttgcccactgacgtgctggaaattgaggtgaaggacaagtttgccaagagccgccccatcatcaagcgcttcttgggaaagctgtcgatgcccgttcaaagactcctggagagacacgccataggggatagggtggtcagctacacacttggccgcaggcttccaacagatcatgtgagtggacagctgcaattccgatttgagatcacttcctccatccacccagcagatgatgaggagatttccctgagtaccgagcctgagtcagcccaaattcaggacagccccatgaacaacctgatggaaagcggcagtggggaacctcggtctgaggcaccagagtcctctgagagctggaagccagagcagctgggtgagggcagtgtccccgatggtccagggaaccaaagcatagagctttccagaccagctgaggaagcagcagtcatcacggaggcaggagaccagggcatggtctctgtgggacctgaaggggctggggagctcctggcccaggtgcaaaaggacatccagcctgcccccagtgcagaagagctggccgagcagctggacctgggtgaggaggcatcagcactgctgctggaagacggtgaagccccagccagcaccaaggaggagcccttggaggaggaagcaacgacccagagccgggctggaagggaagaagaggagaaggagcaggaggaggagggagatgtgtctaccctggagcagggagagggcaggctgcagctgcgggcctcggtgaagagaaaaagcaggccctgctccttgcctgtgtccgagctggagacggtgatcgcgtcagcctgcggggaccccgagaccccgcggacacactacatccgcatccacaccctgctgcacagcatgccctccgcccagggcggcagcgcggcagaggaggaggacggcgcggaggaggagtccaccctcaaggactcctcggagaaggatgggctcagcgaggtggacacggtggccgctgacccgtctgccctggaagaggacagagaagagcccgagggggctactccaggcacggcgcaccctggccactccgggggccacttccccagcctggccaatggcgcggcccaggatggcgacacgcaccccagcaccgggagcgagagcgactccagccccaggcaaggcggggaccacagttgcgagggctgtgacgcgtcctgctgcagcccctcgtgctacagctcctcgtgctacagcacgtcctgctacagcagctcgtgctacagcgcctcgtgctacagcccctcctgctacaacggcaacaggttcgccagccacacgcgcttctcctccgtggacagcgccaagatctccgagagcacggtcttctcctcgcaagacgacgaggaggaggagaacagcgcgttcgagtcggtacccgactccatgcagagccctgagctggacccggagtccacgaacggcgctgggccgtggcaagacgagctggccgcccctagcgggcacgtggaaagaagcccggaaggtctggaatcccccgtggcaggtccaagcaatcggagagaaggtgaatgtcctatactccataattcccagccagtaagccagcttccttccctgaggcctgaacatcatcactacccaacaatcgatgagcctcttccaccaaactgggaagctcgaattgacagccacgggcgggtcttttatgtggaccacgtgaaccgcacaaccacctggcagcgtccgacggcagcagccaccccggatggcatgcggagatcggggtccatccagcagatggagcaactcaacaggcggtatcaaaacattcagcgaaccattgcaacagagaggtccgaagaagattctggcagccaaagctgcgagcaagccccagcaggaggaggcggaggtggagggagtgactcagaagccgaatcttcccagtccagcttagatctaaggagagaagggtcactttctccagtgaactcacaaaaaatcaccttgctgctgcagtccccagcggtcaagttcatcaccaaccccgagttcttcactgtgctacatgccaattatagtgcctaccgagtcttcaccagtagcacctgcttaaagcacatgattctgaaagtccgacgggatgctcgcaattttgaacgctaccagcacaaccgggacttggtgaatttcatcaacatgttcgcagacactcggctggaactgccccggggctgggagatcaaaacggaccagcagggaaagtcttttttcgtggaccacaacagtcgagctaccactttcattgacccccgaatccctcttcagaacggtcgtcttcccaatcatctaactcaccgacagcacctccagaggctccgaagttacagcgctggagaggcctcagaagtttctagaaacagaggagcctctttactggccaggccaggacacagcttagtagctgctattcgaagccaacatcaacatgagtcattgccactggcatataatgacaagattgtggcatttcttcgccagccaaacatttttgaaatgctgcaagagcgtcagccaagcttagcaagaaaccacacactcagggagaaaatccattacattcggactgagggtaatcacgggcttgagaagttgtcctgtgatgcggatctggtcattttgctgagtctctttgaagaagagattatgtcctacgtccccctgcaggctgccttccaccctgggtatagcttctctccccgatgttcaccctgttcttcacctcagaactccccaggtttacagagagccagtgcaagagccccttccccctaccgaagagactttgaggccaagctccgcaatttctacagaaaactggaagccaaaggatttggtcagggtccggggaaaattaagctcattattcgccgggatcatttgttggagggaaccttcaatcaggtgatggcctattcgcggaaagagctccagcgaaacaagctctacgtcacctttgttggagaggagggcctggactacagtggcccctcgcgggagttcttcttccttctgtctcaggagctcttcaacccttactatggactctttgagtactcggcaaatgatacttacacggtgcagatcagccccatgtccgcatttgtagaaaaccatcttgagtggttcaggtttagcggtcgcatcctgggtctggctctgatccatcagtaccttcttgacgctttcttcacgaggcccttctacaaggcactcctgagactgccctgtgatttgagtgacctggaatatttggatgaggaattccaccagagtttgcagtggatgaaggacaacaacatcacagacatcttagacctcactttcactgttaatgaagaggtttttggacaggtcacggaaagggagttgaagtctggaggagccaacacacaggtgacggagaaaaacaagaaggagtacatcgagcgcatggtgaagtggcgggtggagcgcggcgtggtacagcagaccgaggcgctggtgcgcggcttctacgaggttgtagactcgaggctggtgtccgtgtttgatgccagggagctggagctggtgatagctggcaccgcggaaatcgacctaaatgactggcggaataacactgagtaccggggaggttaccacgatgggcatcttgtgatccgctggttctgggctgcggtggagcgcttcaataatgagcagaggctgagattactgcagtttgtcacgggaacatccagcgtgccctacgaaggcttcgcagccctccgtgggagcaatgggcttcggcgcttctgcatagagaaatgggggaaaattacttctctccccagggcacacacatgcttcaaccgactggatcttccaccgtatccctcgtactccatgttgtatgaaaagctgttaacagcagtagaggaaaccagcacctttggacttgagtgaggacatggaacctcgcctgacattttcctggccagtgacatcacccttcctgggatgatccccttttccctttcccttaatcaactctcctttgattttggtattccatgatttttattttcaaaccaaatcaggattgacaaaagctgtgcatgaagaactgccttcttctaagatctaaccttcaggcttctctcctctgttttcaatgaactgctagcctgtatgcaatattaaaaaacagctgtctcaaggtctgtgtatatctccacatacctccattactaacaatgaaatatgaatgcaagttaagctacacttgaccaaatggtaataaatgtttacttccatttctatcattgaagggaaaatgtgagcattaagcactccaggctttcatatgcccatgtcttctgagcagagccaccattttttataatttctaataaccaactccagaactaggagctgatcaactctttgttttcctctccatctacttttccctgtgcataatatccatccaaaggacaacagtggcaaagctgaaatttttatacattcaactcatgattcacatgtggcatcagtcccatcagccggaactagcctagacatacggtgcaaatatgacacttctaacgattaacaacagcaagaaaacacctgctgctgatgcaatgcaatgcatcccaatggttgtggggattgtgggctcaactcaagagaagtttaggagggggagcatccctagtgaatactcacaccacaagaaggacaaacttgtgcacatgtccaagaaagaaagcttcttgattgaggtagcatgaaggatgaggcttcagcccccattgtcttatgtagaatgtggcaatgccaactggagaaagggaagaaggacatattaccttggtttgaatccctgagttctgtactgttctgttttgtttagtctagccacagttcttcacaaaggaaaaaaaaatgtgtagatgataccatgacttttgttaaagccatgacttttgtttgcttggcagacaaaccctttttttaaaactttgatatttttttttcacatttttttttccttttcctttcttaatcatggagttcaagttcctttgcattcgattgtccatcgggaccacactaggaagctgcagagagtgatggtgcttgttagggatcaagggcaacatagtacttctccttcacccatagtaatcctcctggggcagaaacataacaccccaaaggcacgttgatttgtatcaaaataaatatccagtttcttttagcattcagtgaaaacatatctcagaaaacttcatgttgtcagaaaaacagctgcaggctccaaagacagcctaacctctcaactacatttgaaataaacccaaccataatggt

SEQ ID NO: 458 - DNA, 3311 bp, Homo sapiens
gtggtgcccatcagcatgtggagccggccaccgcccctgcctccatagaagcccgctgccgcccagtccgcggtaccttgagggtcacgtcgcacagcttgccctgccgccggatctcctccatgacgccgtagccgcgactaggcaactcagacacggagaagtgcaccagatcctccagctcctccgcgccgtcctccaccatcttccccggccgctgcaactgcgcaggcctcgccggccggctagacactaaccagggcggggcgatagcgcacgccgacagccgctcggagcgcggagcagcaatcggacgggcctccgcggccgccgtagttgaatctcctcggcgccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcagctccttggcaagaaaggaaggtgccagcagccctgtgaatgggaaggacttggattacgtttccacctccaagacccagctggtcccatcctccaaagatggggatgtcaaagacatgctttcgcgggaccgggaaacttccagcattgagccccttccctcagactccccgaaggaggaattacgcccaattaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatagaacctcatcgccagtaccttaaaggacaagaccagcaactcccacctactgtagtggagctgctcaaccacctgcccagagctgcagccccctctactccaatgctgggacccagcacagagaacacatttggcctgcatgttgggaggagcatcctccaaggacaaccttgctcatctccacagagcactttgggttttaattcactgtcttatatgcagggacaggataaaataactttctagtttggactttca

SEQ ID NO: 459 - DNA, 1055 bp, Homo sapiens
gaggggacgcgcgcagatgacgtgcggctcgtggggcagctcggcagcatggcgtccgtgacgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgggagtgaaagcagaaatggggacgccgaagctggagaaaccaaatgaaggctacttggagttctttgttgactgttcagccagtgctacccctgaatttgaaggtagaggaggtgatgaccttggcaccgagatcgctaacaccctctatcggatatttaacaataaaagcagtgtcgacttaaagaccctctgcattagtcctcgggagcactgctgggttctctatgtggatgtgctgcttctggaatgtggtggaaatttgtttgatgccatttccattgctgtaaaggctgctctcttcaatacaaggataccaagggttcgagttttggaggatgaagaggggtcgaaggacattgaattgtcagatgacccttatgactgcatacgactaagtgtggagaatgtcccctgcattgtcactctgtgcaagattggctatcggcatgtggtggatgctactcttcaggaggaggcctgctcgctggccagcttgctggtgtcggtgaccagcaagggagttgtgacgtgcatgaggaaagtggggaagggcagcctggacccagagagcatcttcgagatgatggagactggcaagcgtgtgggcaaggtactgcatgcctccttgcagagtgttgtgcacaaggaagaaagcctggggcccaagagacagaaagttggattcctgggatgatttgcacatcaactgctcaactgtggattgttttttacttttccttttaaaccggttcgtatatatttttcttcgctgttacgaatttacagcagcatttgtacatgtaaaattaaaggctattttctggt

SEQ ID NO: 460 - DNA, 4794 bp, Homo sapiens
cgtgggcacctccagataagaaaacaagctcagagagatgtggtgacttgctcaaatagtgacagaacttcctcggccatatggaggggtcatataatacccttgtgtcttcagtttgaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactga

SEQ ID NO: 461 - DNA, 4787 bp, Homo sapiens
agcgcgcatgctcgcggctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgtacaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccagacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaaggtttcactgaatgcgaaatgacgaaatctagccctttgaaaataacattgtttttagaagaggacaaatccttaaaagtaacatcagacccaaaggttgagcagaaaattgaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaa

SEQ ID NO: 462 - DNA, 3352 bp, Homo sapiens
agtcaccccggcatgtgggcgcggcggggcggcgcgggcgggacggctacaagagctgttttgcgtccgggccggagtatttgctcagcccgcctgcgccgcttgggacgcctctgcctttccctccctcccttccccgacggcttctggcggccaagtggatgtggcgggtgatcgagccaccctgcccaggggcgcccagcactggttcagtgaacagcattttggacaggacatttggtgccaggtctgagtagccagtttgctgaattattgtcccagtcagccaggattgtgagctgtttgggaagtttcgtggaaacgcccaagtgccagcacaggtggagggacacctggaggccagtttcaggaacttttgccacaagtataaaagacttcagaagtgcaaagatgctgaaacagatactgtcggagatgtacatagatcctgatctactggcagagctcagcgaagaacagaaacagatcctgttcttcaagatgagagaggaacagatccgacgatggaaagaaagagaagcagctatggaaagaaaggagtccctgccagtgaaacccagaccaaagaaagagaatggcaaatcggttcattggaaacttggagctgataaggaagtctgggtatgggtgatgggcgaacaccatctagataaaccctatgatgtgctctgtaatgaaattattgctgagagggcccggctgaaagcagaacaggaggcagaagagcccagaaaaactcactctgaagaattcaccaatagcttgaaaacaaaatcacagtaccatgatctgcaggctccggataaccagcagactaaagacatctggaagaaagtggcagaaaaggaggaactggagcaaggatcgaggccagcaccaaccctggaagaagagaaaatccgatcactctccagttcttcaagaaatattcaacaaatgttggcagattcaatcaatcgtatgaaggcatatgcatttcaccagaagaaagaatctatgaagaaaaaacaagatgaagaaataaatcaaatagaagaagagagaacgaagcagatttgtaagagctggaaagaagactcggaatggcaggcatctctgcgaaaatccaaagcagctgatgagaagagacgctccttggctaaacaagcacgagaagactacaagaggttatccctcggggcccagaaaggaagaggcggtgagaggctgcaaagccccttgcgtgttccgcagaaaccagaaagacctccccttccacccaagcctcagttcctaaactcaggggcatatcctcaaaaacctcttagaaatcagggagtggtgaggacactgtccagctctgcccaagaggacatcatccggtggtttaaagaggagcagctaccacttcgagcgggctaccagaaaacctcagacaccatagccccctggttccatggaattctcacactcaagaaagcaaatgaacttcttctgagcacaggcatgcccggcagttttctcatccgagtcagtgaaaggatcaaaggctatgccctgtcctatctgtcggaggacggctgtaaacatttcctcatcgatgcctctgcagacgcctacagcttcctgggcgtggaccagctacagcatgccaccttggcggatttggtggaatatcacaaggaggaacccatcacttccctggggaaggagctccttctctatccctgtggtcagcaggaccagctgcctgactacctggagctgtttgagtgacagcctccatcagggtcatcctacagcctccaagcgggctttcccctggacaaatgccactgcaacatttatgtgtgaagccaaaatcaccctgcagcagagccaatactgatcaactgaaagtaaagtatccatggagtcctcattgacacctcttttctgcacaaatactggaattcaatgtcaagagaaaatgacctctgctcaaaagggagaagagtctcaatttcagcaagtacctgtcatgaagggtatgaccttaatgatgtacataaaataaaacaaatgaagaaatggaaaacttttagaaattaaggtgtacttgaaaacgaatatctatcatatgacccctgcactccctctgtatcatctcaggaggtttcaggggcctgttgacatgaagtttcgaagtttcatgttggctttggaatggtagcaaaagcctttcctggctgagatgatgcttaaaacacacctcacttattgtacatgttggaaccaggacatgagagacatagaaaaacagaagtcatgaatgtaaattgaatgagaggcttaacatgcatgaaaatacagatggacctgcaggaaagtgagcaaacatcgctgagtttgttttcttgttcgggagaatggggccggggctggcctggcctcccctggatatactctatagtgcaccaaaaggataaagcatctgtacatgtatttttttattttttatcagaagtgcttagacaagaacagaataagcaggctgtttggatgctacttgtggttgaattgtgttcccccaaaatatatggtgaagtcttaacccccatccccgtgaatgggaccttgtttggaaatagggtctttgcagatatagtcaagatgaggtcacattggattagggtgggccccaaatccaatgactggcatccttaggagaagagagagttttggtaatagacacaaatgcagtgggaagaagaccaggggacaagaggcaagttggagtgatgcagccggaagggaagggacaccaaggatctccggccaccagcagaagccagcagagaggcatgggacaggttccccacaagccttagaaggaagcatggccctgacttcagaattccagactccagaactggaagaataaatgtctgttgttttaagctgcttagttcatgctgagttcatgctgacttgttactatagccccagaaagctaatacagtcgtttatgtaattacataacctgacacacaagatcgacccattcactgctgcccagtccaccattttcataatgaagtagaaatgggaggtaagaaaaacattccagccagttctgtttagccctggcacacatatttgtcccgtcaggaatcttatgccctcctggaacccccgcccacctcagtccagtcccagtcaggcgaacggcctctggacagggactgaggtggctctgagccactggagatcatttttcttggaggatggagattggctagtacctctggcctaactgtgtaggtcaatactcttttacattgccttctaataaaagcagaatgatacagca

SEQ ID NO: 463 - DNA, 2238 bp, Homo sapiens
ccctttccccactgtggtgtgataagaggctgccctcacagtcacaatgctcccgggtcacagaggtgctgggccccaggccagcctctgcctgggaagttctctctgggaacatctggtgggtactacaggccctattccaggccctatggcctgtggaacctcaccacgggggggagggctgggccagacggagacatcacctgtggtgtcagccccatggatgagacagagtggatacacagacatcccaaggctgaggacctaagggttgggctcatcagctgggcaggaacctacctcacctttgaggcatgcaagaatacagtcactgcaactgcgaagagtttgggcaggagacagacctgggagatcttggtgagcaatgagcatgagacacaggccgtggtgcgactaaagagcgtgcagggcctctacctgctgtgtgagtgtgatggcaccgtgtgttatggccgcccaaggaccagccaccatgggtgctttctactgcgtttccaccggaacagcaagtggaccctccagtgcctaatctctggtcgttatttggagtccaatggcaaggacgtgttttgcacttcccacgtcctctcagcttaccacatgtggaccccccgaccagccctccatgtccacgtgatcctctacagccccatccaccgctgctatgcccgggctgaccccactatgggccgcatctgggtggacgcagcagttccctgcctggaggagtgtggcttcctgttgcatttccgagatggatgctaccacctggagacctctacacaccacttcttgtcccatgtagaccggctgttctcccaaccctcatcacagacagcttttcacatgcaagtgcggcctggagggcttgtggcactgtgtgatggagaaggaggcatgttatatccacagggcacgcatctgctcttgggcatgggctgcaaccccatgaggggtgaggagtggttcatcctacagcactgcccaacctgggtcagcctcaggtcaaagactgggcggttcatctcagtcatctacgatggtgaggtgcgtgctgcttctgagcgcttaaaccgaatgtccttgttccagtttgaatgtgacagtgagagccccactgtgcagcttcgttcagccaatggctactacctatcccagaggcgccacagggcagtaatggctgatgggcaccccctggagtctgacacgttcttccgaatgcactggaactgtggcaggatcatcctgcagtcctgcagggggcgcttcctgggcattgcacccaacagcctgctgatggccaatgtcatccttccaggcccaaatgaggaatttgggattttatttgccaatcgctccttccttgtattgcgaggtcgttatggctatgtgggctcctcatcgggccatgacctcatacagtgcaaccaggatcagcccgaccgcattcatctactaccctgccgaccgggtatctaccacttccaggcacaggggggatccttctggtcaataacatcctttggcacctttcgcccttggggcaagtttgccctcaacttctgtatcgagcttcaggggagcaacttactcactgtactggcccccaatggcttctacatgcgagccgaccaaagtggcaccctgttggcagacagtgaagacattaccagagagtgtatctgggaattttaggtcaatgggatgtcacctaccaaaatccaaatcctccaggaaaaactactacactaaatggaccaggaacctcagagtcaagatccaagagaagaacatctgttacaacttttcctacccagtttagcaaaacacctgttttatgcaacaatacatcacaacaggccacccccaagatccttgtgtgcatctgactcaatatagaataggggtctggatgagggttgaaacagacaccccaggctgctctaagttctatacaggagagaccaaatggcaagcagttcttccactgatcttccccgtccccatccagaactgctagactttttccagtgaacccatgagcagccagcattgccctgaagggtttagaatccagttatgactttaaatatctttttggtttagaaaaaaggaaagattgttaatctcgtgagcacaggataatggtaataacaccttatgcctgtataggccactttacctcctcctaccacgatttatttaacttccccaccc

SEQ ID NO: 464 - DNA, 1566 bp, Homo sapiens
ctctctcccggcctgcgggccgcttcccaccacagaccccgccccgcgccctacccatcacgcgtccccggtccggctccggcgctcacctacccccggcaggcgccgcccccgtgccgtccctcccggaagcgccggcggagcgtcctcgcatggagcgcgagcccagcgcctcggaggccgcccccgcggcggccgcgctcttcgcctggggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcgtctccgcattgcttaactggagcaactgaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 465 - DNA, 3481 bp, Homo sapiens
agtcgtgcgacgccgggcggttgcgtgtggtgcgcgggggcgcgggctgcgtgtggcgcggggcggggcgcggctggtgcgcttgagaagcgatggcggcggcctgaactcacctaacaccgcagcagcaaccgggcccggccaggttcggcgttccgtgagtgaacgatttagaaatctggactggccagtgacctctgggcttgccattccagcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcctggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtggctcaccccctggtgcagaagcagttggttgattatatccataatgggttcctggtgcctgtcatgggtcctgccttgcacaagacctctgtggaggagatgatcgccagtaccgcctatctggaacttttcctacggagtatctcagagcctgctttgctccgtaccttcctgcgattcctgttgttgcaccggcatgacacccacaccatcctcgacaccctcgttgctcgtattggcagtaactcccggctctgcatggtctctctgagtctcttcaggaccctcctgaacctcagctgtgaggatgtcctgctgcagctggttctcaggtatcttgttccatgtaaccacgttatgctgagccagaagccggctgttcgtgatgtggacctatatggacgagcagctgacaagtttctctccctaatcccacgctgttgtcggcaccacgcccccagcccacctcgtccagagcatgcctcatgggcacgaggtgggcctagcagagagacagggagaagggaggacatcacgggtcctggaagcccaagtgtggactcctcttctgtgacgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattacctggagtatctgcgtgaggcacgtcgtggtgtggaccgctgtgtccgagcctgccgtacctggtctgccccctatgatggcgagcggccctctcctgagcccagtccttttggctcccggactaagaaacgcagcctactgcctgaggaggacaggaacaacgtgggggaaggggaggaggaagagctggggaggagggggcgggctgggggtgcaggggagggccctggtcacctgccccctccccagctcaatggagtgccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggccccttcatggctgtgctctttgccaaactcgagaacatgctgcagaactccgtctatgtcaacttcctgctgacggggctggtggcccagctggcctgtcacccccagcccctgctccgctctttcctgctcaacaccaacatggtcttccagcccagtgtcaagtccctgctgcaggtgctgggctctgtgaagaataagattgagaactttgcggcttcccaggaggacttcccagcactgctgtccaaagccaagaagtacctcattgcccgtggcaagttggactgggctgagggccctgcagcaggacctgccccacgccgttctgatcccctagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctagggcacaggctcctttttatgtttggaggcagtggcaaaaggactttttaatttatttcagatgaatgttttatggagaacttgttgcaatatgtataaaagggaaatctcta

SEQ ID NO: 466 - DNA, 8544 bp, Homo sapiens
cacgcactacgggttggcgccagagtcaaaaggcgtcggccctctggcaagatggctgctgcggaggcgttggagcgcggaaatctggaaccgggatggcgacgtctacactgagtcggaggcgaaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatccacgaaggaagacaggaggtccgaggagaaagcggcagccatggcagcctcaaagaaaacagcccctccaggctccgcggtgggcaagcagcctgcacctagaaacctcgtgccaaagaagtcttcttttgctaatgtggcagcagccacaccagccattaaaaagccaccctcaggtttcaagggcaccatccccaagaggccatggctctccgctaccccatcgagtggtgcttcagctgccaggcaggccggaccggcacctgcagcggcaacggctgcctccaagaagttccctggctccgctgctttggtgggagccgtaaggaagccagtggtaccttctgttccaatggcctcgccagccccaggacgccttggggctatgagtgctgcaccatcgcagccaaattcacaaattcggcaaaatatcagacgctccttaaaagagattttgtggaaaagagtcaatgacagcgatgacttaatcatgacagaaaacgaagtaggaaaaattgccctccatattgagaaggagatgtttaacttgtttcaagttacagataatcgctacaagagtaaatatcgcagcatcatgttcaacctgaaggaccctaaaaatcagggactcttccatcgtgttctgcgtgaggaaatctctttggcgaaacttgtgagactgaagccagaagaacttgtatctaaagagctttccacgtggaaagagaggccagcgagatctgtgatggagtccagaactaaactgcacaatgaaagcaagaagacggcccccaggcaggaggccatccccgatctggaggactctccgccagtgtcggattcagaggaacagcaagagtcagcacgtgctgtccctgagaagagcacagcgccgcttctcgacgtcttcagcagcatgttgaaagacaccaccagtcagcaccgcgcacacctcttcgatctcaactgtaaaatttgcacaggccaggttccctccgcagaagatgagccagctccgaaaaaacaaaaattgtcagcttctgttaagaaagaagacttaaaatcaaagcatgacagctctgcacctgacccagctccggattcagctgatgaggtgatgccggaggctgtgcctgaagttgcctctgagccaggcctagaaagtgcttctcatccaaatgtggacagaacgtatttccctgggcctccaggagatggccatcccgagccctccccgctggaagacctgtccccctgcccagcctcctgtgggagcggggtggtcaccaccgtcacagtgtccggccgggaccccaggaccgctccaagcagttcatgcacagccgtggcctccgcagcatcccgcccagacagcacccacatggtggaagccagacaggatgtgccgaagcctgtcttgacttctgtgatggtgcccaagtccatactagctaagccatcctcatctcctgacccaagatacctgtcagttcctccgtcaccaaatatcagcacttcagaatcacgttcccctccagagggagacacgaccctctttttgtctcgactcagcaccatttggaaaggatttattaacatgcagagtgtggcaaaatttgtcactaaggcgtatcctgtctctgggtgttttgattacctcagtgaggatttgcctgacacaattcacattggtgggaggatcgcaccgaagacagtttgggattatgttggcaaactcaagtcttctgtgtctaaggagctctgtctgatccgcttccaccccgccacagaggaagaggaggtcgcctatatctctctctactcctatttcagcagccgtggccgctttggtgttgtagctaataacaacaggcacgtcaaggacctctacctgatcccgctgagcgcccaggaccctgttccatccaaactcttgccctttgagggaccaggtcttgagtcaccacgtccgaatataattcttgggttagtaatctgccaaaaaatcaaacgtcccgcaaacagtggagagttagacaagatggacgaaaagcggacccgacttcaaccggaagaagcggacgttccggcctatccaaaagtagccacagtcccgcagtcggaaaagaagccctccaagtatccactctgctctgcagacgcggctgtcagcaccacacctcctgggtcgccgccgcctccgccccctcttccagaaccaccggtgctaaaagtgctgtcatccctcaaacctgcagcccccagcccagccacagcagccacaacagcagcggcagcctccacggcagcttcctccaccgcttcgtctgcttccaaaacagcatcaccgctggagcacatcctgcagactctctttggaaagaagaaatcattcgacccgtccgccagagagcctcccgggtccaccgcaggtctcccccaggagcccaaaaccacagcagaggacggggtgccggcacctccgttgttagatccgatcgtccagcagttcggtcagttctcaaaagataaggctctagaggaagaggaggacgacaggccatacgaccctgaggaggagtacgacccggagagggccttcgacactcagcttgtggagcgagggcggcgccacgaggtggaaagggctcctgaagcagctgcagccgagcgggaagaggtggcctatgaccccgaggatgagaccatcttagaagaagcgaaagtgactgttgatgacctgcccaacaggatgtgtgccgacgtgagaaggaactccgtggagaggcctgccgagccggtggccggggctgcgacgccctccctggtggagcaacagaagatgctagaagagctgaacaaacagatcgaggagcagaagagacagctggaggagcaagaagaagctctcaggcagcagagggccgccgtcggggtctccatggcccacttctcggtgtcggacgccttgatgtctccaccaccaaagtcgtccttgcccaaggcagagctgttccagcaagagcagcagtctgcagacaagcccgcctcactgccccccgccagccaggcgtcaaaccacagggacccccggcaggcgaggcgcctggccactgagaccggtgagggggagggggagcctctctccaggctctcggcacgtggtgcccagggtgccctgcccgagagagatgcttccaggggtggcctcgtgggccaggcgcccatgccagtcccggaggaaaaagagccagcctcttccccctgggcttcgggcgaaaagcccccagcggggtccgagcaggacggctggaaggcagagcctggggagggcacccgccccgccacggttggagacagctcggccaggcctgcccggagggtgctgctgcccacaccgccttgcggcgccctgcagcccggcttcccgctgcagcacgacggtgagagggaccctttcacctgcccggggttcgcgtcgcaggacaaggctctcggctcagcccagtatgaggacccaagaaatcttcattctgctggaaggagcagcagccctgcaggtgaaacagagggggacagagagccacaggccagacccggcgagggcaccgccccgctccccccaccaggacagaaagtggggggctctcagcccccgtttcagggtcagcgggaacctggacctcatgctttggggatgtcagggcttcacggccccaatttcccgggaccaagggggccagcccctccgtttccagaagagaatatcgcttctaacgatgggccacgagggcctccgccagccagattcggagcccagaaggggcccatcccttccttattctcggggcaacatgggccacctccttatggggacagcagaggcccctcaccctcttaccttggtggaccacgaggagtggcaccatcccaatttgaagaacgcaaggatccccatggggagaagagggagttccaggacgccccgtataacgaggtgacgggcgcccccgcccagtttgaagggacagagcaagccccatttctgggaagcagaggcggcgcgcctttccagttcggaggccagagaaggccactgctgtctcagctgaaaggcccccgaggcggcccccctccctctcagtttggaggtcagagaggaccaccccctggtcatttcgtgggcccaagagggccccatcctagtcagtttgaaactgcccggggccctcatcccaaccagtttgaaggacccagaggccaagcgcctaactttatgccaggtcccaggggcattcagcctcagcagttcgaagaccagagggtccattcaccaccaagattcacaaaccaaagggcgcctgcacccctgcagtttggtggactacgggggtccgcacccttttctgaaaaaaatgagcagaccccttcgcgatttcacttccagggccaggccccgcaggtgatgaagccgggccccaggcccctgctggagcttcccagccaccccccgcagcaccggaaggaccgctgggaggaggccgggccgccctccgcgctctcctccagtgcgcccggacagggccccgaggccgacggacagtgggcatcggccgacttccgagaggggaaaggccacgaatacagaaaccagactttcgaagggaggcagagagagcggtttgacgtggggcccaaagagaagccgctggaggagcccgacgcccagggccgggcgtccgaggacaggaggagagagcgcgagcgcggccgaaactggagccgagagcgggactgggaccggccccgggagtgggaccgacaccgggacaaggactccagccgggactgggacagaaaccgggagaggagcgccaaccgcgaccgagagcgcgaggccgaccggggcaaggagtgggaccgcagccgggagcggagcaggaaccgagagcgcgagcgagaccggaggcgcgaccgggaccggtcccggagcagagagcgggaccgagacaaggccagggacagggagcggggccgcgaccgcaaggaccggagcaagagcaaagagagcgctcgggacccgaagcccgaggcctcgagggcctccgacgctggcaccgcctcgcaggcctagacgccccggccgggcagagaccctttttaaagccacgttcgtaagatgcgttgaacaaatagcttttgaaatagccacgatcttagattcaggatagaatattctggacttaaacattactgtaattttgtgtaaatggtttcttacaagatttcacatctttacaattctgatgcttttttaaaaaaactaaactttaatatttccatttaaaattaaaagaaatgggaaattgcctacggagcatattgcttttcagatcatagttatcttttccaataactttattgtaaattttaagggagtttcgttggaccctagagccataccttcactgacatctcatccgtttgtgtttccaaaagctgcttttacaggtcttagccgccgccccggaggccggtgtgggcgtgacctgcaggcgtccaccctgcggctacgggagaagtcttagtagcttgtatctggagtcttgagaaacacaaaccttacaaatgcatctttcttttgtcataaaattggaattacaattttcaactgggaaacagaaacacatttcttagcgtgctcagattttatatatcaccttatcaattttttccaaaacatgatttaaagcaacatctgtcctagtataattgttgcattttaaataacaatttattgaaaaatgttaagttttaccagcctaaaaaaagtaacaaaccaattaagtgtactttgggggcagggaggagtccttgatttgaataatcaggagttttgttggtccagtttcgccttctgagcagttcttctgtatcccgggaaaagtacgctcggccccaaactggtatttgtcagacgatacatgtaaaagtttgtccttgaacgtggaacaagacttgtgtaaagtctgagacgggaactagtgatcactagctcaagaactgcaaatgagacaggaagctgttcactgtgaaacagtctcttgcttgtcgtgtatttttcgagtacttctgaagtgtgaagtaaaaaaatctggctaatttatttgtacaaatacactttgataattttttatattttcataaacttttacagatgtaaaattaaagaacttcacttgttctttggagtctgttattccattgtacgtcactacagatttttcactttatagcacagattttttaagttaagaaaacattgagaatgtatcagtttgagatgtttggtgttgaaagccaagtgtccataggttaaattacattaaagtaggtgtcacgttccaacatctagtacgatgagaaggttttgtttgtttaacatataaagcaaatttttctaatttaaatacacaaatgtaaaaatcaagtgtgtttctttagtttacttgatagagattcctgtacattgtattttatattgcggaggcttatatcactgtacatgagaacatggaacgacctaggttttgttactcgcagtagaataaacagctacaggaagtttc

SEQ ID NO: 467 - DNA, 1961 bp, Homo sapiens
cacgcactacgggttggcgccagagtcaaaaggcgtcggccctctggcaagatggctgctgcggaggcgttggagcgcggaaatctggaaccgggatggcgacgtctacactgagtcggaggcgaaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgctctggtaagtattcgtattctcttcatcccagtctgattgcatag

SEQ ID NO: 468 - DNA, 1731 bp, Homo sapiens
gtcctgagagtcagccctcgccgctgcagcctcggcgcccggccggccggccatggagcgccccccgccccgcgccgccggccgggaccccagtgcgctgcgggccgaggcgccgtggctgcgcgcggagggtccggggccgcgcgccgcgcccgtgacggtgcccacgccgccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagagagccaccccaggaaaagcccggctggacgaggtcatggctgccgctgcccttacaagcctgtccaccagccctctccttctgggggccccggttgcagccttcagcccagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaagagcccggcccaggtcatgttccagtgtctgtggaagagctgcgggaaggtgctgagcacggcgtcggcgatgcagagacacatccgcctggtgcacctggggaggcaggcagagcctgagcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccagggctgcctgacgcccgcccgcctggagccgcagcccacggaggtcggagcctgcccacccgccttgtcctccaggatcggagtcaccctgaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggctttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttccagaa

SEQ ID NO: 469 - DNA, 3039 bp, Homo sapiens
atgctgagattctgtgcaggcctttctgactttgcaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatgg

SEQ ID NO: 470 - DNA, 2505 bp, Homo sapiens
atgaggctcctggatgggaaacagacttccaggtactcagagaatgcctgcgagaagaagattttctctatctacggacactacccggtggtccgggccgctctgcgaaggaagggctgggtagagaagaagttccactttttgcccaaggtcattccggatgtcgaggatgaaggcgcccgggtcaatgatgatacatgtgccaaagtcaaagaaaatcaagaaatggctttggagaaaacagacaacatccacgacgtgatgtctaggttggtaaaaaatgagatgccgtacctcctctggaccatcaagagggacatcattgactatcacagcctgacctacgaccagatgctgaaccactacgcaaagacagcctccttcaccaccaagatcgggctgtgcgtgaacatgcggagcctgccctggtacgtcccggccaaccccgactccttcttcccacgctgctacagcctctgcaccgagagtgagcagcaggagttcctggaagacttccggcgcaccatggcatccagcatcctcaagtgggtggtcagccaccagagctgcagcaggagcagcagaagcaagcccagggaccagagggaggaggccgggagcagcgacctgagcagcaggcaagatgctgaaaatgctgaggcaaagctcaggggcctcccggggcagcttgtggacatcgcgtgcaaggtgtgccaggcctacctggggcagctggagcatgaggacatcgacacgtcagcagatgccgtggaggacctcactgaggccgagtgggaggacctgacccagcagtactactccctcgttcaggtgcctttggggagtagcattgtcttgtgcatcttcaaaatccagaaggttatgatgtcatttgagccccccacagcccgagacaggcagtgccaggctctgctgaatagaatcacgtctgtgaaccctcagacggacattgacgggctccggaacatctggattataaagcccgcggccaagtcccggggccgaggtgagtcccctgacatagtgtgcatggaccgtgtggaggagatcctggagctggcagctgcagaccaccctctttccagggacaacaagtgggtggtccagaagtacatcgagacgccgctgctcatctgtgacaccaagttcgacatcagacagtggttcctcgtcacggactggaaccccctgaccatctggttctacaaggagagttacttgcggttctcaactcagcgcttctccctggacaagctggacagcgccatccacctgtgcaacaacgccgtccagaagtacctgaagaatgatgtgggccgcagccccctgctgcccgcacacaacatgtggaccagcaccaggttccaggagtacctgcagcgccagggccgtggcgccgtgtggggcagcgtcatctacccgtccatgaagaaggccatcgcccacgccatgaaggtggcccaggaccacgtggagcctcgcaagaacagctttgagctctacggggctgacttcgtccttgggagggacttcaggccctggctgatcgagatcaattccagccccaccatgcacccgtccacgccggtcacggcccagctgtgtgcacaggtgcaggaggacaccatcaaggtggccgtggaccgcagctgtgacatcggcaacttcgagctcctgtggaggcagccggtggttgagccgcccccattcagcgggtccgacctctgcgtggcgggcgtcagtgtgaggagagccaggaggcaggtgctgcccgtctgcaacctcaaggcctcggcctcgctgttggacgcgcagccgctgaaggcacggggcccctcggccatgccagaccctgcccagggacccccatcaccagctctccagcgggacttgggactgaaggaagagaaggggctccccctggccttgctggcacccttaaggggggcagccgagagcggtggagccgcacagcccacccgcaccaaagctgctgggaaggtggagctcccggcctgcccctgtcgccacgtggacagtcaggccccaaacaccggtgtccccgtagcccagcccgccaaaagctgggatccaaaccagctaaatgcgcacccgctggagcctgtgctgcggggcctgaagacagcagagggcgcgctgcgtccgccgcccggaggaaaaggagagggcacggtctgcagccgcctgccacaccacgggcaccacgtggccgcctgccagaccacgggcaccacgtgggatggtgggcctggggtgtgcttcctccggcagctcctggcatcagaactgcccatgggccctgggctgccgagggacccccgagcgccgccctgcctcgtgtgccgcgggctgctgccacccgccgggccctgcaagcgctgccgctcgttctgcgccgcggtcctgcagggcgcgtccttcgtgcggctcggcgggcggagctgcagcccgcggaccccgtga

SEQ ID NO: 471 - DNA, 2039 bp, Homo sapiens
aatgacatgacagccattccgtggccagggacaccactgcccaagctggagaccacgaggattcagggactgaagccagcatgggaattcctggtttgagatcagagtcctgagtacctcgtgggaacttgggcactcatccgcaggaggtctagacccccagagaattccttgagtctaaggcacaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaagatgaagaagaacaaatactagccaaaattgttgagctgctgaaatattcaggagatcagttggaaagaaaggacactgccttcatccccattcccttggttgacaccagcatccagggttttccacaggatggtttgatggcctgcatttgagctaaagaatgaacttctgtctgcctcgtggagccaagctactgtactgagtgcttattcttttgtacacagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggaaaaaatacttgggatatcacatgaagaagtagactgaaatatcagatttgtcatcaggaatactctttgtctactgtggtcctgtgcacgttggcctcagatggactacaggagattacaacgtacaaggcagatggagcattgacgttttcaaaaccattattcctgtgactggagaggcatcaggagaggtctcgttcgtctccagctcataaaatgtagcagcatcatccttgacagtgatgtttttcaggccctccattgagaacctgaggaaatctgtaaagataagtggtgatgttgtttcaaacgttcagaacagataccatcatcctgcctttgttagctgctgtagggaaagtgcgttacagatgtctgctgacctcacaagagtgaaaagataaactgtgcatgtgtttccacttccgtttctagtactatttatttttaaactacacttggggtggcctaatacctaggaagatgttgctattcacgttagtaaacagcctaaagaaactcttaggtttactgctacatccatttgtttggagaggtaactgttgtctgtgcctttttgaaaaacttccatttggtacaaaatttttactccaacaccccctcaacccttttctcagggaccacacctcttcttcccaaggtccctgggacttcctcattctttgtggtagtacaatgattggtagcaggtaaaataaatacatagaaagactactgtcaaaa

SEQ ID NO: 472 - DNA, 1389 bp, Homo sapiens
ggtgggaggtgaaaggtcatagtcctgtttggcggccatttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagcttgcaaatacagaagaatacatagatggagctttgtctggacatctgggtgaagttttaataaggtgtaataatgtcctttatatcagaggtgtggaagaagaggaagaagatggggaaatgagagaatagcatcttttgtgggggattttttttatatatatttctagacaataaagatttgtttgtttttcaacttgacttgtgaactatttgtattcagatatttacaagcaaagctgaaatgatgaaccaattgggaaagattactcactgaactaatgctttaaaagccactgaatttcatttaagttgcttttcttttgtaagcccaatattcttttttttcccataaaggataattatttatatgctttagatatttttatgaaggtgaatttcagaccttttcttgtaaaattatctattagctgagaccttttaaatgcaactttttcttttaaagttatttttgagctacttttaacgtataaaattaaacattttcttggtattaataatatactgtcttattttacttagtagtcaataaattacatgttaattctgtgtcaatataagctaaatgcacatattgcagctaaaattgaagcatcttctaaaaattaaaatgattgtacagacagggcacaacagaaattgggaactgacattcaggctgaaggcatacggtttgttcactgaagagaaaaaagttctctgaacaaaatgtaatgtcaaataaaaaccagtctccccattatgttctgagacataacctcgaggttgagttttaagcccctcaaaacccttcaggtattttagggttgtacattgttaaaatgtatagtccatagtaataacagtatgctatgaacttccctacagatgggttgagaaaatacatcatttacattctcatgttgtaagagaatggccattattacacttcagtgttcatttaccatagttttatcagtaaactatctttgtgtatccccaagtgggacaactcaaagtatagaagaaagtgtttagctatatggaataatacttatgatatgaatacttaaagacttaaaatttacaaaatacacctaagacattctggtaa

SEQ ID NO: 473 - DNA, 2136 bp, Homo sapiens
accctcccagccccggacagcgcaggctgcggcttttcgtcctccactgagtcctgccggtggcccgagcccggtggcctcccggcgaccctcggcgcgaggcgacatggcaagcggccacagcctcctgctggagaacgcgcagcaagtggtgctggtgtgcgcccgcggcgagcgcttcctggcgcgggatgcgctgcgcagcctggcggtgctggaaggcgccagcctggtggtgggcaaagatggatttataaaagctattggtcctgctgatgttattcaaagacagttttctggagaaacttttgaagaaataattgactgctctgggaaatgtattctaccaggtttggtggatgcacacacacatccagtatgggctggtgaaagagttcacgaatttgcaatgaagttggcaggagccacctacatggaaattcaccaggccggaggagggatccactttaccgtggagcgcacgcgccaagccacagaggaggagctgttccgctccttgcagcaacggctccagtgcatgatgagggctggcaccacgctggtggagtgcaagagtggatatggcctcgacctggagaccgagctcaagatgctgcgcgtgattgagcgcgcccggcgggagctggacatcggcatctcggctacctactgcggggctcattcagtgcctaaaggaaaaactgctactgaagctgctgatgacatcatcaataaccacctcccaaagctgaaggaacttggcagaaatggggaaatacacgtggacaatatagacgtattttgtgagaaaggtgtctttgatctcgattccaccagaaggattcttcaacgtggaaaagatatagggttacagattaacttccatggggatgaactccacccgatgaaggctgctgagcttggggctgaactgggagcgcaggcaatcagccacctggaagaagtgagtgatgaaggcatcgttgccatggcaacggccaggtgctctgccatccttctgcccaccacagcctacatgctgagactgaaacaacctcgagccaggaagatgttagatgaaggagtaatagttgctctgggaagtgatttcaaccccaatgcatattgcttttcaatgccaatggtcatgcatctggcctgtgtaaacatgagaatgtccatgcctgaggccttggccgctgccaccatcaatgcagcttatgcactgggaaagtctcacacacacggatcgttggaagttggcaaacagggagatctcattatcatcaattcatcccgatgggagcatttgatttaccagttcggaggccatcatgaattaattgaatatgttatagctaaaggaaaactcatctataaaacatgatagatttgaaaagagaagactttttgactatatgaaataagtcaatatagttatattaaaagttaaaacaccttaatatttacaagaattatatcacttaaacctaaatgtacttcaatgtctttttaagtcactcaaaaaacccaagggatagatttattttcatttaacacatgcatttgacatataaacaggtaaacctattgtgattaaaatcacaaaacatccaattagttcacaaatattggttacaaatattctgtagattaatatggtggggtatcacaaaaatgcctttgtggggaaaagtaggcttggcttaaaatttccattttgtgtctgtatttcacatctcagtttttaaactatatttagtgaacattgagggatcgaaagaaatctaagtgatacgccccaatgaagctaaaatatagccttctgttaagcaaatagtatttcctttccccaagtagttcattttctagatgcttgtcaaatgaattaatgtcctctgatgaagagtgtccttccgtttctaaggtcttctcaatctcagcaatagagcttcccagcagcgttcaagacacatcatttatacacaggcacaggggccttcctgaaatgggtgcatttttaccaactacaatcatgtaatttttttggaaattttttaaaattttcgattctttacattacaattgggtgaaacacattttacagctctcaataaatgtttgctgtcgctctta

SEQ ID NO: 474 - DNA, 5909 bp, Homo sapiens
ggcgctcagcgcaggcaggtccccctgctgccgggtcccatttgttgccggctctgactcggggcggccgcggcgcgcggagctccggggagtcaggcggagcagccgcgcagccacgacggagcagcagcgggactggccgccccgcgcccccttcgccgccgtgcccttccccggcgcgctcaccccgttctcgggatgggattgtagcggcggcgcggactcggcggggatcgcggcggaggcggcggcgtcggcggcggcgtcggcggccgagcggggctccatgttttcccctggccaggaggaacactgcgcccccaataaggagccagtgaaatacggggagctggtggtgctcgggtacaatggtgctttacccaatggagatagaggacggaggaaaagtagatttgccctctacaagcggcccaaggcaaatggtgtcaaacccagcaccgtccatgtgatatccacgccccaggcatccaaggctatcagctgcaaaggtcaacacagtatatcctacactttgtcaaggaatcagactgtggtggtggagtacacacatgataaggatacggatatgtttcaggtgggcagatcaacagaaagccctatcgacttcgttgtcacagacacgatttctggcagccagaacacggacgaagcccagatcacacagagcaccatatccaggttcgcctgcaggatcgtgtgcgacaggaatgaaccttacacagcacggatattcgccgccggatttgactcttccaaaaacatatttcttggagaaaaggcagcaaagtggaaaaaccccgacggccacatggatgggctcactactaatggcgtcctggtgatgcatccacgagggggcttcaccgaggagtcccagcccggggtctggcgcgagatctctgtctgtggagatgtgtacaccttgcgagaaaccaggtcggcccagcaacgaggaaagctggtggaaagtgagaccaacgtcctgcaggacggctccctcattgacctgtgtggggccactctcctctggagaacagcagatgggctttttcatactccaactcagaagcacatagaagccctccggcaggagattaacgccgcccggcctcagtgtcctgtggggctcaacaccctggccttccccagcatcaacaggaaagaggtggtggaggagaagcagccctgggcatatctcagttgtggccacgtgcacgggtaccacaactggggccatcggagtgacacggaggccaacgagagggagtgtcccatgtgcaggactgtgggcccctatgtgcctctctggcttggctgtgaggcaggattttatgtagacgcaggaccgccaactcatgctttcactccctgtggacacgtgtgctcggagaagtctgcaaaatactggtctcagatcccgttgcctcatggaactcatgcatttcacgctgcttgccctttctgtgctacacagctggttggggagcaaaactgcatcaaattaattttccaaggtccaattgactgacgcccttgacagccatctacgactttattaacaggttactgtgaagattttgccactaactctagattttacctttttgtaatgctgtttatcagaggagggtgacaggggctggaaataaagagaggggacatggtgatgaaacatggcaggagtgtaacagataccagtggtgtgttgcatgctcaaaacagcagcgtcgtcattgaagtctgcttgattaaaccataatatctttgtaataattggatttaaaatgctatgcttctatttttaaccttgggtttttaaccaagtttttttttttttgtaatcttggacaagactttaaatcatattttacagatgtagaagaaatttattcaaaagtgtgggctcatgaagttcacttcagtgcagtgtggtgtaggtgttacgcgaagggcgcacagtgtctagaaatacttgatcgtggctcaaacctgaccagacagcagaggggcggctctgtacagtgtgactggtggacagatggccttaggcacaggtggttttgaaatctggggctttttctgatttatttttctgacttgttgggggagagaatattcataacttgtgggctttttttttttttaacttcagtggaatttactttagatattcattcatcaaatacatgggacttcacaaacaattttccataactttttagcctgtcttttgttatttctgcctaatatgatttgccccgatactcatcttgcacggccagaactgtttggttgattaaaatacatcagctcttaaaaactcattaactgagggtaattacagtagtagacatggtctgggtactatactaccatgtttatttgctgactgaattaagatttaagaatgattaaaaataagcttttactttttaaaaccacttgaggtttcataaagcttggggtttttttttttcctttgttaagaaagccaaccaatcacaatgatatagtcattgttgtgcactcccttttcaccatctgtcaccttcccttgcagcttaaggagcccagtaagttttgaaaatgtttgcgaatcaaactaaatttaagtgggatgattagatatacacaacaccaagtggtacatctgcagagataattcaaaattcctgcttttgagagagcaaatgagtgttgctgaggaataattaaatgagaatttcataggagctccaccattcctgttactttcatttcattttgattaataattcttggatgcttggcatcgatcgtatcactgctcctagaaggtaaagatcctttaggacatgagactggtagaagctggctgagataaaataagtatttatttaaactaatgttctcttaatttgaccattgcagatttgggtgacttttttttaacctttgtacatatacgtaatttatatgattctaatgtactatatccatacttgaattggttttttcgtattttgcctactggcaaatattttgcctattttcagtcgttctaacctatttgaatacgcttttccttaaagtgatacgataatattactcttgattgctgctgcttaatttgatgtaatatgtttaaagttcagcctctcagttttaatatagctttatttttcagtggagatcattgtttaggatgagacatttttggttttggttttgtttgggtaaattttaaatggtgtgaaaatcgatgacaacagtcctcttacagatagcttgctgtattctgtatagcttactctacctgcagacagaaaatgaaagaaaaaaatggacttgcctagaataatatattgaatgccttttgatttagccagagtctctgatgattagctttcactgatagagtatgtcttttcagcctgtaattctttgggccccaaagaatgacaaaggaggcactcgttctcttttcttgctgtatgcctagaaagtggttgaaggattcttgatgccctaaaaccatcttgtaagctaaatggtcttgcatccagaaaggccagattttacctaccaagaaaaaaagatatttttccagagagttaggtatatcataattttccatttcaagtcctgtttataagtctagtcattctgcaacgtgacatatcccccaaaatgaagttaccttccaagttggacacgtcccgtagttgggcatatgtctaactaaaagtttctgacttttagtaaattcagcttaaatataagttgaaatttgggaaataatttccaagctcttggaaggggtaacagtgaaccgccctccatgggctccacatcttttcctttggcttccaaagtcaggtcccgcccaccctgcctaaggaactgcagagaggtggcaaatcagcaaaaaggacaccaggctcttcttggccacttgtaggaagatccctttacaattttgactaaggagattttttttttcacagttgagttagtttgtgaaaataaagaactctgtagctcaccaaggtggagaaacgcaattcagaaaagtaatttctccaaggtcacttctttttttatgtcttgccatcactttaaaggactagccccactcccccatgtgtatacacaaggaaattgcagaccaattagttgtcttggcctgactctaatgccttttgcaagtagctttccagaagtaaaagtcccagtgatgtattcccatagaaatatttttcagttgtttatgtcgtttactacaaaaaaaaagattcagagtggatggagtacaactctgagtatttttctagtccggaattttttattaataatcggtgctgccgggtcatgcatgctgcaactctcaacatttcccttatttggttcagcttttagcaaaaagggctacagttcaccctgcagagtattaaggtttctggatttttttctcccaactgtggcccaaaagaattaaaatctgttaatataaatagagaacatatttatcattcctcgatagttaattatagactttggtacctttgtgcctcagggaagccacgtgatataactggttatagaatttcagggttagggtttaaagaaaggagaaagccattggaaaaatgatgggctccattaaggagactaatgaatctggatgcagaaatatgtcagaaactggcataaacatgattgtagtagaatttattttccagtaccaatagggaaattattttaagttattacatttactgtattgggaaacttgaggagaactctttagttcataaagcttcaatgtcttttttttttttttcatggaaaaactcaaacctctgttatttgggagctcagtattgtgtggacacttacgagagttttctgcttaattgaagtgtaatataggttgtagaattgttacctgcagttctatggttttgtttcacttcttttcttttttaaagccattctgttctttggatgtgcttgaaagggtgtgtgattacaccattgttaatgctgggtaaaaactatcttcttgcagccttgcctcataacagtggaatttctgatagacaaaccacaggactttgattttaagccaaatccatctccatccctttactgtcaatcttctgtcccagtagtttagcctttgtggcttaggttatgatgcgcctccttctgtgcgaccaatgagacgacttcagcatctttttaaaataatctaagcatcattgaagcagtaacacaaaaaaaaggttcagtattttctttttagtataacttacatcctttcaaataagtctttgccctcatgaagaatccctagaggaagataaggaaaataagtattttccagttttgcttgacagtttctaaacaaacaaaaataaactcaatgaaaggaaagatgtttctttttagctgagatgacagattgcttctctgtattaaatagtctagaagttaaggggatggtcacatttaccatgtattgtgttattagcagttaaattttatgaatatgtttgtaaaattgttgttttatatttcatgtcaaattgaaaagtttatttcttcactattgtacctgtggaaatacaagccattttacaggaaaaaatcttcaaaaactattaaatggatatcagcctgtttgtgagccattgtcttcagattctgtggttgtcactgagttcattaggacatttagtaggttgatacgagtagaactgatttttttcacttctctaacttccaagttaatctccagctgttgagtttattaattgttttatattctgcacaatacatatttaaaccttgattctgaaaatcccctacattttttaattaaagaaatttccttggtgcctata

SEQ ID NO: 475 - DNA, 2559 bp, Homo sapiens
agtgacgcgcgagcggctcccgcgactgtggctcccgaagctgcttcgggccccagcggtgaggaagaagactctcaaccagggtgacttctaggcgtcctcccggagctaccggggacactggcgttattgcccgcaacactgagatagggaatgctcgagaaacagaagcaggagtattttatacagaaatcttgtgaaaccactgcccaaccagagcaatgattgttcaaagagtggtattgaattctcgacctggaaaaaatggtaatccagtggcagagaatttccgaatggaagaagtctatttaccagataatattaatgaaggacaagtacaagttagaactctttatctttctgtggatccttacatgcgttgtagaatgaatgaagacactggcactgattatataacaccttggcagctatctcaagtcgttgatggaggaggtattggaattatagaagaaagcaaacacacaaatttgactaaaggcgattttgtgacttctttctattggccctggcaaaccaaggttattctggatggaaatagccttgaaaaggtagacccacaacttgtggatggacacctttcatattttcttggagctataggtatgcctggtttgacttccttgattgggatacaggaaaaaggtcatataactgctggatctaataagacaatggttgtcagtggggccgcaggtgcctgtggatctgtggctgggcagattggccatttcttaggttgttccagagtggtgggaatttgtggaacacatgagaaatgcatcctcttgacctcagaactgggctttgatgctgcaattaattataaaaaagacaatgtggcagaacagctccgtgaatcatgcccagctggagtggatgtttattttgacaatgttggtggtaacatcagtgatacagtgataagtcagatgaatgagaacagccacatcatcctgtgtggtcaaatttctcagtacaacaaagatgtgccttatcctcccccgctatcccctgctatagaggcaatccagaaagaaagaaacatcacaagggaaagatttctggtattaaattataaagacaaatttgagcctggcattctacagctgagtcagtggtttaaagaaggaaagctaaagattaaagagacggtaataaatgggttggaaaacatgggagctgcattccagtccatgatgacaggaggtaacattggaaagcagatagtttgcatttcagaagaaatctctttgtaattgctgtaaatgtcatcaaggcaatcatagatttcttttccattttgcatattttcaaagatatgttaaaaaatccttagactatacatagctcttgatttaaatgtgatcataggtgttatttttagttgcatagggtatttgatacaatcattaatggatcatacacaataggtttttaaaaattaataacttttagtaattacttttattaatttaaaatagaacgcttgagaggcactttgtaaagatttgttaaactggaaacgttttacatgatctgatacaaccattaatgaatcatacacaataggttttttaaaattaatattaataacttttattaatttaaaatagaatgcttaaaataaaatagaatgcttgagaggcactgagtaaagatttgttgaactggaaatgttttacatgattcttaaactgaaacttggtgtaaaaatagaattgagatggcctttttttcacattgtagactgaaaagagacttaatggtatgatgtgtacatagggactgggggcaggattgggggtttcggagcttgtgtaacagtttttgggataggagaccagcggttttgggttgggattagtatgggaagataaataacttaggttggttaagttgacaagatttactccagaggatcatctctttgtatttgccaaataatttactgtatagcctaaaaactccatatatattgagaaaagcatatgtttattttaggttagcaggcacatactgtcaagttgtaaagattgagagggcaaacagatgtaaacatcacttgtaggtgattaaaaagattgacagccgggcctgatgtctcaagcctgtaatcctagcactttgggaggcagaggcgggcagatcacttgaggtcaggagttcaagaccagcctggccaacacggtgaaaccccatctctctaaaaatacaaaaattagctgggcgtggtggcacacgcctgtaatcccagctactcaggaggctgaggctggagaatcatttgaacctgggagggggaggttgccgtgagctgagcttgcaccattgcactccagcctgggcgacaagagtgaaattccatctcaaaaaacaaaaacagattgacaacaaagacagtttcagaaaatgacaggactgggcaaattaacaaatgtttgtaaacatgaatgttcaggaactactgatgtacctcaaaagtttgttttattaattgtactcaaccctcgcagaacagtaaaactgaagattattgtt

SEQ ID NO: 476 - DNA, 3300 bp, Homo sapiens
aagcgagtggcgctttcaccttagcaaccagcgcggctcccaccatggctgaagaagaggaaactgctgctctcacggagaaggttatccggacccagagggtgtttataaacctgttggattcctacagcagcggaaacatcgggaagtttctatctaactgtgtagttggggcttcgcttgaagaaattacagaggaagaggaagaggaagatgaaaataagtcagctatgctggaagcttcctcaaccaaagtgaaggaaggcacattccagattgtgggcacgctgtccaagcctgacagcccgcggcctgactttgcggtggagacgtactctgccatctctcgagaagaccttctcatgcgcctgctggagtgtgatgttattatttataacatcactgagagctcacagcaaatggaggaagccatctgggcagtctctgcactcagtgaagaagtcagccactttgaaaagcgaaagctatttattttactgtcgacggtgatgacttgggcgcgctccaaagccctggaccccgaggattctgaggttccattcactgaagaagattatcgaagaagaaagtctcatcctaattttctggaccacataaatgctgaaaaaatggttctcaaatttggaaaaaaggccagaaaatttgcagcatacgtagttgctgctggactccagtatggagcggaaggaggcatgttacacacattttttaagatggcttggttgggcgagattcctgcattaccagtttttggcgatggaacaaatgtaattccaacaatccatgttcttgatctagcaggagtgatacaaaacgtcatagatcacgtgccaaagcctcactacctggttgctgtggatgagtctgttcataccctggaagacatagtcaagtgtatcagtaaaaatactggccctgggaaaatccagaaaatacccagagaaaatgcatacctaaccaaggacttaacgcaagattgtcttgaccatttactggtcaacttaagaatggaagcgctctttgtgaaggagaattttaatattcgatgggctgcccaaacaggatttgtggaaaatatcaacactatcctcaaggagtacaagcaaagcagaggattgatgccaatcaagatctgcattcttggtccccctgctgtgggaaaatccagtattgctaaagaattggccaactactacaaactgcatcacatccaactgaaggatgtcatttctgaagccatagcaaaactggaggcgattgttgcccctaacgatgtaggggaaggagaagaagaagtcgaagaggaagaggaggaggagaatgtggaagatgcacaggagctcctagatggcatcaaggagagcatggagcagaatgcaggtcaactagacgatcaatatataattagatttatgaaagaaaagctaaaatcaatgccttgcaggaatcaaggttatattttggatggattcccaaagacctatgatcaagcaaaagacctgttcaatcaggaagatgaggaggaggaagatgatgtcagaggcagaatgtttccctttgataaattaattatacctgaattcgtttgtgcactggatgcttcggatgagtttctgaaggagcgtgtgataaaccttcctgagagcatcgtggcggggacccactacagccaagaccgattcctccgggctctgagcaactaccgggacatcaatatcgacgatgagactgtcttcaactattttgatgaacttgaaattcacccgatacatattgatgtaggaaaacttgaagatgctcagaatagacttgctatcaaacagctcatcaaagagattggggagcctcgaaattatggtttaacagacgaagaaaaggcagaagaggagcggaaggctgcggaggagcggctggccagggaggctgctgaggaagcagaacgcgagcaccaggaggccgtggagatggcagagaagatagctcgctgggaggagtggaataaacgactggaggaagtgaaaagagaagaaagagaattactggaggctcagtcaattcccctgagaaactatttaatgacctatgtgatgccaactcttattcagggcctgaatgaatgttgcaacgtccgacccgaagaccctgttgattttctggcagaatatctcttcaagaacaatcctgaagcacagtgaaacttgaaagatctggtattatctacctttacagaaccacagatcacttattatactttgaaaaattgctttgaaaaatgcttttccagttcttagaaaattctttttttgtagacaaatattctataaactagaatctctattaaaagctatatgacatgactatgtcattaaaactatatttgaaatgtaaattgataaagacatttgtgcatagctcatgagacaaatactgatttaatattttattctttagtcagatctaaatataccgcttctgtacactaatgtttataggtatttatagcatgaagaaaatcagactatatattgtagactatgtattattctaacatgtaggctaatttacatgacttgttatcgccccaataacaatgttattagaaatggaaataaattgaagtgatttatgcctgttgactcacagtaaatcagacaagattggtgcctgtaaggtggctttttttttttttttttttaaatgaagcaatggttagggaaaggttgctttgagttcagggtcaggatcccagacaatgaatcggagagaactgtaaacctttaggcggagaaatctgcataacaggataattccaatctttgtgataagtgagaagttgctaaatattttcaacacactttataacataggcataagttatcaatcctatagtcttttccagttctaaaaatcccataagattcctagaattaccctaaatgagaaattagtttaggtttaatggcatatgtattttatctctttaaataatgtaacctaatataactgcccgactttttatttgtgctaaaatacatgtaacataaaattgaccactgtaaccattttaaagtgtataattcagtggcactaagttcattcacaatgatctgcagccaccactatctagtccagaactttctcatcaccccaaatggaaacccagcacctattaggcagtcacgctccattattccctccccccagttccaggcaaccacgaatctgctttctgtctctatggatttacctattataaataaaaccatataatgggtggtc

SEQ ID NO: 477 - DNA, 3118 bp, Homo sapiens
ggccgaggaggaagtggcggcggcggcggcgggactgcgcgccccagctccgatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattctctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcatgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggggtctgggctgtgctccctcactaaagggaaggaaaggaagctgggcgtcctctgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccacccccttgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctctgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgca

SEQ ID NO: 478 - DNA, 1067 bp, Homo sapiens
agggaaggattctgggagacggaggaggagacgccagcatttcgccccctgcacctccagcgggctgcggtccgctcccggcctcactcgagcaggccccgccctcccagaggcagttagtccaagtcacgtgatcgtcgactcagctgaccctgcgggaccggaaaaagaaattcccgggccctggcttcttggcgcgatgaggttccggttctgtggtgatctggactgtcccgactgggtcctggcagaaatcagcacgctggccaagatgtcctctgtgaagttgcggctgctctgcagccaggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcatgaataggttggcaggtgtgggctggcgggtggactacaccctgagctccagcctgctgcaatccgtggaagagcccatggtgcacctgcggctggaggtggcagctgccccagggaccccagcccagcctgttgccatgtccctctcagcagacaagttccaggtcctcctggcagaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaaggaa

SEQ ID NO: 479 - DNA, 2134 bp, Homo sapiens
ggcggctagcggcgaggccccttcctgaccttcagggatcggccaccatgtcccaccggaagttttccgcccctcggcacggacacctgggcttcctgccccataagaggagccaccggcaccggggcaaggtgaagacgtggccgcgggatgaccccagccagcccgtgcacctcacggccttcctgggctacaaggcgggcatgacccacaccctgcgggaggtgcaccggccggggctcaaaatttccaaacgggaggaggtggaggcggtgacaattgtagaaacgccgcccctagtggtggtgggcgtggtgggctacgtggccacccctcgaggtctccggagcttcaagaccatctttgcagaacacctcagtgatgagtgccggcgccgattctacaaggactggcacaagagcaagaagaaagccttcaccaaggcctgcaagaggtggcgggacacagacgggaaaaagcagctacagaaggacttcgccgccatgaagaagtactgcaaggtcattcgggtcattgtccacactcagatgaaactgctgcccttccggcagaagaaggcccacatcatggagatccagctgaacggtggcacggtggccgagaaggtggcctgggcccaggcccggctggagaagcaggtgcccgtgcacagcgtgttcagccagagtgaggtcattgatgtcattgctgtcaccaagggtcgaggcgtcaaaggggtcacaagccgctggcataccaagaagctgccgcggaagacccataagggcctgcgcaaggtggcctgcattggcgcctggcaccccgcccgcgtgggctgctccattgctcgggccgggcagaagggctatcaccaccgcacggagctcaacaagaagatcttccgcatcggcaggggcccgcacatggaggacgggaagctggtgaagaacaatgcatccaccagctacgacgtgactgccaagtccatcacaccgctgggtggcttcccccactacggggaagtgaacaacgacttcgtcatgctgaagggttgtattgctggtaccaagaagcgggtcattacgctgagaaagtccctcctggtgcatcacagtcgccaagccgtggagaatattgagctcaagttcattgacaccacctccaagttcggccatggccgcttccagacagcccaagagaagagggccttcatgggcccccaaaagaagcatctggagaaggaaacgccggagacctcgggagacttgtaggctgtgtggggtggatgaaccctgaagcgcaccgcactgtctgccccaatgtctaacaaaggccggaggcgactcttcctgcgaggtctcagagcgctgtgtaaccgcccaaggggttcaccttgcctgctgcctagacaaagccgattcattaagacaggggaattgcaatagagaaagagtaattcacacagagctggctgtgcgggagaccggagttttatgttttattattactcaaatcgatctctttgagcatttgcggagcagaggttttttttttttttttttttgagagagtcttgatcttgtcgcccaggctgctggagtgccggggagcagagtttttaaggataacttggcgggtggggagagccagtgagccaggagagccgattggtcagggaggaaatcacagggagtcagctgtcttcttgcgctgagtcagctcctgggtggtggccacaagatcagatgagccagtttatcaatctggttggtgccagcagatccatcaagttgcagggtcggcaaaatatctcaagcactgatcttaggggcagcttagggagggtcagaatcttgtagcctccagatgcacgactcctaaaccataattcccaatattgtggctaatgttagtcctaaaaatgcaatctagtccccaggcaaggaggtggtctgctttgggaaagggctgttactgtctttgttttaaactataaactggctgggcgcggtggctcacgcctgtaatcccagcactttgggaggccaagatgggcggatcacctgaggtcgggagttcaagaccagcctggccaacatcgagaaacctcgtctctattaaaaatacaaaatta

SEQ ID NO: 480 - DNA, 8473 bp, Homo sapiens
ggagggagaggggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccata

SEQ ID NO: 481 - DNA, 3326 bp, Homo sapiens
gcacttccgggccggccgattccgcgcgtctccgcccatcatggcgctcgtgccagtgtcccgtgggctacccactcctgtcatgtcctttgggctggtgcaggccagatcttctagggccgtagccctgagaggagcgcctggagaggaaacggcgcgccatgcacctcacacggcccctcagacctcacggcgaggccctatcagggtaatggtgtccgccggactcgcacaacactccgccggactcgcacaacactccgccgcactcgcacaagactccgccgcggcgacctctactgaaagacccccagtcctggtgtcgcccgaaggcccaggaaaccgtgcttccgcgcttctcccccagaacgtgggaagctgccgctttaccctcattttaccccagggtcgcaaaacatctcaccgtagttgaagccagcaagccggaccaggcgtcccggccaagccacgtgcgcgccccgcgccgcgagtgctcgccccgcccctagggaggagccggccgacccccggccacttagcagtgccgcagccgacggggtgcggttcggcgctcccaggttcctttcctcactgcacgctcttgcccctcctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccataccccagcccatggtcccatgactaggtggatagtactccttgtacctcctgcaacccagaaccctggctgaccactttgaaggaggatgctccagcaggtcaatggccacaatccggggtctgatggccaagccagggagtacctcagagaagacctgcaggagttcctgggtggggaggtcctgctgtacaaactggatgacctcaccagggtgaatcctgtgacactagagacagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccagaaactgaagccccatgtgttcactgtgggtgaacagacctacaggaatgtcaagagcctgattgaaccagtcaaccagtctattgttgtcagtggagagagtggtgctggaaagacatggacgtctcgctgcctaatgaagttctatgctgtggtggccacctcacctgcatcttgggagagccacaagattgcagagaggatagaacagaggatcctgaactccaaccctgtcatggaagcttttgggaatgcgtgtacactgaggaataacaacagcagtcgctttgggaagttcatccagctccagctgaacagggctcagcaaatgactggagccgcagtccagacctacctcctagagaaaactcgagtggcctgccaggcttccagtgagaggaacttccacatcttctatcagatttgcaaaggagccagtgaggacgagaggctccagtggcaccttcctgagggagctgccttctcctggctgcccaacccagagaggagcttagaagaggattgttttgaggtgaccagagaggccatgctccatttgggcattgacacccctacccagaacaacatctttaaggtcctagctggactgctgcaccttggcaatatccagtttgctgcctccgaggatgaagcccagccctgccagccgatggatgatgccaagtactctgtcaggacggcagcctcgctgctggggctcccagaggacgtgctgctggagatggtgcagattagaaccatcagggcaggcagacagcagcaggtgttccggaagccctgcgcccgagccgagtgtgacacccgtagagactgcctggccaaactgatctatgcgcggttgtttgactggctggtatcagtgatcaacagcagcatctgtgcagacaccgactcgtggaccactttcataggcctgctggatgtgtatggatttgaatcatttcctgacaacagtctggaacagttgtgcatcaactacgccaatgagaagctccagctggaggcctgtggcctcgtggagaccatccatatcagtgctgctggcttccccatccgggtctctcaccgaaactttgtagaacgatacaagttactaagaaggcttcatccttgcacatcctctggccccgacagcccatatcctgccaaagggctccctgaatggtgtccacacagcgaggaagccacgcttgaacctctcatccaggacattctccacactctgccggtcctaactcaggcagcagccataactggtgactcggctgaggccatgccagcccccatgcactgtggcaggaccaaggtgttcatgactgactctatgctggagcttctggaatgtgggcgtgcccgggtgctggagcagtgtgcccgctgcatccagggtggctggaggcgacaccggcaccgagagcaggagcggcagtggcgggccgtcatgctcatccaggcagccattcgttcctggttaactcggaaacacatccagaggctgcatgcagctgccacagtcatcaagcgtgcatggcagaagtggagaatcagaatggcctgccttgctgctaaagagctggatggtgtggaagaaaaacacttctctcaagctccctgttccctgagcacctcgccgctgcagaccaggctcctggaggcaataatccgcctctggcccctgggactggtcctggccaatacggctatgggtgtaggcagctttcagaggaaattagtggtctgggcttgcctccagctccccaggggcagccccagtagctacactgtccagacagcacaagaccaggctggtgtcacgtccatccgagcgctgcctcagggatcgataaagtttcactgcagaaagtctccactgcggtatgctgacatctgccctgaaccttcaccctacagcattacaggctttaatcagattctgctggaaagacacaggctgatccacgtgacctcttctgccttcactgggctggggtga

SEQ ID NO: 482 - DNA, 5675 bp, Homo sapiens
agactgaggctggctggctggaggttgacacaggagtgctcaggggagcagcatcacaagagggcagatcgaaagcatcgtccttgctgaaaaacagatggcagaggtggaagcggtacagctgaaggaggaaggaaaccggcatttccagctccaggactacaaggccgccacaaatagctacagccaggccctgaagctgaccaaggacaaggccctgctggccacgctttatcggaaccgggcagcctgtggcctgaaaacggagagctacgtccaggcagcttcagatgcctccagagccatcgacatcaactcctcggacatcaaggctctgtatcggcgatgccaggcactggagcacctggggaagctggaccaggccttcaaagacgtgcagcgttgtgccaccctcgagccacggaaccagaacttccaggagatgctgaggagactcaacaccagcattcaggagaagctccgagtgcagttctccacagactcgagggtacagaagatgtttgagatcctcttggatgaaaacagtgaggctgataagcgggaaaaggctgccaacaatctcattgtcctaggccgtgaggaagcaggggctgagaagatcttccagaacaatggagtagccttgctactgcagcttctggacactaagaagcctgagctggtgctggctgcagtgcggaccctgtcgggcatgtgcagcggccaccaagccagagccacagtgattctgcatgcagtgcggatagaccgaatctgtagcctcatggccgtggagaatgaggagatgtctctggctgtctgcaacctgctccaagccatcattgactccttgtctggggaggacaagcgggagcatcgagggaaggaggaggccctggttctagacaccaagaaggacctgaagcagatcaccagccacctgctggacatgctagtcagcaagaaggtgtctggccagggcagggatcaggcgctgaacctgctcaataagaatgttcccaggaaggaccttgccattcatgacaactcacgtaccatctatgtggtggataatggtctgaggaagatcctgaaggttgtggggcaggttccagatctgccatcctgcctgcccctgactgacaacacccgcatgctggcctctatcctcatcaacaagctctatgatgacctgcgctgtgacccggagcgcgatcacttccgcaagatctgtgaggaatatatcacgggcaagtttgacccccaggacatggacaagaacttgaatgccatccagacagtgtcagggatcctgcagggcccctttgacctgggcaaccagctgctgggactgaaaggtgtgatggagatgatggtggcactatgtggctcagagcgcgagacggaccagctggtggccgtggaggccctcatccatgcctccacgaagctcagccgcgccaccttcatcatcaccaatggagtgtcactgctcaaacagatctacaagaccaccaaaaatgagaagatcaagatccgcacactggtgggactctgtaagctcggctctgcaggtggcacagactacggtctcaggcagtttgcggaagggtcgacagaaaaactggccaaacagtgtcgcaagtggctgtgcaatatgtccatagacactcggacccgacgctgggcagtggagggcctggcctacctcacgctggacgctgatgtgaaggacgactttgtccaggacgtccctgccctgcaggccatgtttgagctggccaaggcaggtaccagtgacaagaccatcctgtactcggtggccaccaccctggtgaactgcaccaacagctacgatgtcaaggaggtcatcccagagcttgtccagctcgccaagttctccaagcagcatgtgcccgaggaacaccccaaggacaagaaggactttatagacatgcgggtgaagcggcttctgaaggcgggtgtcatctctgccctggcttgcatggtgaaagcagatagtgccatcctcactgaccagaccaaggagctgctggccagggtattcctggcactgtgtgacaacccaaaggaccgaggcaccattgtggctcaaggtggtggcaaggccctgattcccctggctttggagggcacagatgtgggcaaggtgaaggcagcccacgctctagcaaagatcgctgctgtctccaatccggacattgcttttcctggggagcgggtgtatgaggtggtgcggccccttgtaagactcttggacacacagagggatgggcttcagaactatgaggctctcctaggcctcaccaacctgtctgggcggagtgacaaactccggcagaagatctttaaggagagggccttgccagacatcgagaactacatgtttgagaatcatgatcagctgcggcaggcggccaccgagtgcatgtgcaacatggtgctccacaaggaggtacaggaaaggttcttggctgacgggaatgaccggctgaagctggtggtgctgctctgcggggaggatgatgataaggtgcagaatgcggctgcaggggctctggccatgctgacagcagcacacaagaaactgtgcctcaagatgactcaagtgacaacccagtggttggagatcctccagcggctttgcctgcacgaccagctgtctgtccaacaccggggcctggtcattgcctacaacctactggcagccgatgctgagctggccaagaagctggtggagagtgagctgctggagatcctgactgtggtgggcaaacaggagccagatgagaagaaggcagaagtggttcagacagcccgagaatgtctcatcaagtgcatggattatggtttcattaaaccagtgtcttagacagcgaccctcagggatgctgggagtggtcctgtactgtgcagagtcctgggttggttgggttctcctgaagagtcaggtcatctagggatcatagcagtgacaatgaagtctcaatataaaggaaagacttgattgttctctgagttgtgagtcttctcctttgtcctgacagagtttggatgtttcactctctctcttgcttcctgtctccttatatttgtcatgtttcagaaattcccagaataattttcacccatgattagaaataggttggatcattctttctgtacccattctgaaggccaggataataggttgaagttctttatattttggaaaatggattttgtggtaaggtaggaactaacgggtgtgtgcatataaaggttaatgctgttgtatttggatgctgatctgtgctgttttcatgacctctctcccacactatttgaatcagtctgttcagaactgtgtgtttcacctgcagtgctctgtcccagtcccatgcccattcccatcacttcactgtgatggaaatagagtttatgttcaacagtggggcatgacctctgcaatttgcttgggaaagtcttccaagcaagatggacatgatgaatacaaataagatctactcaaagtacttcaaacaaaaaataaataattcattggctcatgtatcttggccacccagggaaggtctgacattgttagttagatccagagtttcaaatgtcatcaccatggatgtgtctttttctctctctcatttcccctccccatatcttgtcttttatttattataggtttgtctcattccctggcaggctctctccctgtgataggaaagagagtccccagcagccccagggtgacatagttgttatagttcattatggaatagaagagagaagagcattctcaataacccggcaaagttcccagggatgactctgatatgtctatgtctcaggtcacatttccatctatgaaccaatcatattcagaggtggaatgctaattggccaggcctgggtcatatatacaagtctagggaagaaatgagcttcatccctgtccaattgacatggactgattaggggtattaatggaagaggtgtgccaccacaaaagaatgtaccctgggcagatcaaagaacatattctgtatgtcaggcttggccacaaaagaatgacacaagtaatatgctgtagatcagaacctctctgctaatattgcctttttagcatggttaagatagctaagatctagtactgtcactccagtatgtcccaattctacctacgtttattgaagggtcaacagttctgatctcagcattgggtaaagggtgggacattcagatttacggtccttgataaaaacaatttacaacgttccgttgtgtaataaatgtaagtgtacatatgcctgggacatcagctggaaaagggacagactatcagagagttgcactgttgcggtatgggccaaatccaacataatacccgctgtacctctagagaactaaaaccttaatttctcagatcttttctgcactaatggtctttacatacagcctacattttaactaactcttgcatgggcttgtttcacagcaggaaactatattcatcatatccttattatgatagagaatgacaacattcaaaagggtgtggtgcttctgaaaatatacacaataaatggcatgatttgacctctgtcaaattcttctttcctgctttcctcatatgtgggcttgagtgggtgtatttagctcctttaaaggaaactctttcacaggcagggccacactcttactcgttttgatctcatgaggttacatctgccagtggcgttcagggccagttagataaagttcatcttgtttggattggagagactttttttttttttttttttgagacagggtcttgctctgtaacctaggctcaagtgcagtgcagtggtgcagtcatggctcaccgcagccttggtctcctgggctcaagtgatctttctacttcagcctcctcaatagctgggactacaggcacacaccaccacccccaggtaattaaaaaatttttttttgtagagacagggtctcactatgttgcccagtctgggagaccacattctttaacatgaatattttgtaaatagtccaagaagatctagaggaaagctgaattccttcatctgatttttgccactgggctgcctcccattgtctggctaagtcttcatgggaggcctttaagaaaagctgtgacaaatacctttgtttcccactgcctaggttacataagtagttggcttttccagcctagactcttatattgttgcttgtaagagggcccttctttgcagatttcttttttttttcatctatgctttcaaataggcagatgctagcctgagatcatctctttattgaggtagtttgcccaaaaacagcaaggaacagccaatacctgccaactttctaggtttttccaaccaattctcttacagaaaatctataaatatcttagaggtatgtttcttagtttcccaacatataatgggaaaattcatcatttatattattacttttaactgaagtatgttgttatcagagaacttggtctgtgtcatattaatcctttgccatttgagaagcatacagttttaaagtttatatctccaaaaggatattttgtaaaaatttaacccctttgactcttagtcttctcatttgtgaaaggtaaataataaagaatttctgttcctagt

SEQ ID NO: 483 - DNA, 2335 bp, Homo sapiens
gtagtggccccagtccgggccccggcgcgctaggctcacaaaggcaggcacagactgcaaccctgctcagtgctccgggcgcttcaggctggcttgggtcctgctgctccaaccccaagggccctggagcgctccctgatacctccatcactcaccatggccagccagttctgcctccctgaatccccatgtctctcgcccctgaaacccttgaagccacatttcggagacatccaagagggcatctacgtggcgatccagcgcagtgacaagcggatccacctcgctgtggtcacggagatcaacagagaaaactattgggtcacggtagagtgggtggagaaagcagtcaaaaaaggcaagaagattgacctggagaccatactcctgctgaatccagctctggactctgctgaacaccccatgccgcccccgcccttatcccccttggctctggcgccctcttcggccatcagggaccagcgtaccgccacgaaatgggttgcgatgatcccccagaaaaaccaaacagcctcaggggacagcctggatgtgagggtccccagcaaaccttgtctgatgaagcagaaaaagtctccctgcctctgggaaatccagaaactgcaggagcagcgggaaaagcgcaggcggctgcagcaggagatccgagctagacgcgccctcgatgtcaataccagaaaccccaactacgaaatcatgcacatgatcgaagagtatcgcaggcacctggacagcagcaagatctcagtcctggagcccccgcaagaacatcgcatctgcgtctgcgtgaggaagcggcctctcaaccagcgagagacaaccttaaaggacctggatatcatcaccgtcccctcggacaatgtggttatggtgcatgagtccaagcaaaaggtggacctcactcgctacctgcagaaccagaccttctgcttcgaccatgccttcgatgacaaagcctccaacgagttggtgtaccagttcaccgcccagccactggtggagtccatcttccgcaagggcatggccacctgctttgcctatgggcagacgggaagtgggaagacgtacaccatgggtggagacttttcaggaacggcccaagattgttctaagggcatttatgctctggtggcacaggatgtctttctcctgctcagaaactccacatatgagaagctggacctcaaagtctatgggacattttttgagatttatgggggcaaggtgtatgatttgttgaactggaagaagaagctgcaagtccttgaggatggcaatcagcaaatccaagtggtcgggctgcaggagaaagaggtgtgttgtgtggaggaagtgctgaacctggtggaaatagggaatagctgtcggacttccaggcaaacacctgtcaacgctcactcatccaggagccatgcagtgttccagatcatcctgaagtcaggacggataatgcatggcaagttttccctcgttgatttagctgggaatgaaagaggagcagatacaaccaaggccagccggaaaaggcagctggaaggggcagagattaacaagagtcttctagccctcaaagaatgtattctggctttgggtcagaacaagcctcacaccccattcagagccagcaaactcacactggtgctccgggactcctttataggccagaactcctccacttgcatgattgctaccatctctccggggatgacctcttgtgaaaacactctcaacactttaagatatgcaaacagagtaaaaaaattaaatgtagatgtaaggccctaccatcgtggccactatccgattggacatgaggcaccaaggatgttaaaaagtcacatcggaaattcagaaatgtcccttcagagggatgaatttattaaaataccttatgtacagagtgaggagcagaaagagattgaagaggttgaaacattacccactctgttagggaaggataccacaatttcagggaagggatctagccaatggctggaaaacatccaggagagagctggtggagtacaccatgatattgatttttgcattgcccggtctttgtccattttggagcagaaaattgatgctctgaccgagatccaaaagaaactgaaattattactagctgacctccacgtgaagagcaaggtagagtgaagccaatggcgagagatcaggtccgaaatgctgcattgctgcagtttccaccactcttatacaggaaaactgtccaaattatctaaagatcctcctgagaagcttaaaacatcttaaaatacactgatgggaaacatgctctttcttctgcctctgt

SEQ ID NO: 484 - DNA, 1734 bp, Homo sapiens
acgcacgcacgtctctcgctttcgcatacttaaggcgtctgttctcggcagcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaactctatacttctaaggtgccaccaccttctctagtaactta

SEQ ID NO: 485 - DNA, 2664 bp, Homo sapiens
cgagcgcgagccgggagccggggcgggcgcgggcagcggcgggccggccgggctgtgcggggcgagcggcggcggcggcgggggcgcttcggccggggcggcagctgggcgccggcgggagctagcagcgtctgcagccgcgccggccgccagcgccccggcgcgctccggctcggccatggagctgccagctgttggcgagcacgtcttcgcggtggagagcatcgagaagaagcggatccgcaagggcagagtggagtatctggtgaaatggagaggctggtcgcccaaatataacacgtgggaaccggaggagaacatcctggaccccaggctgctgatcgccttccagaacagggaacggcaggagcagctgatgggatatcggaagagagggccgaagcccaaaccgctagtggtgcaggtgcctacctttgcccgtcgttccaatgtcctgaccggcctccaggactcctccactgacaaccgtgccaagctggatttgggcgcgcaggggaagggccaggggcatcagtacgagctcaacagcaagaagcaccaccagtaccagccgcacagcaaggagcgggcgggcaagcccccgccgccgggcaagagcggcaagtactactaccagctcaacagcaagaagcaccacccctaccagcccgaccccaaaatgtacgacctgcagtaccagggcggccacaaggaggcgcccagccccacctgcccggacctgggggccaagagccacccgcccgacaagtgggcgcaaggtgcgggggccaaaggctacctgggggcggtgaagcccctggccggtgcggcgggtgctccaggcaaaggctccgagaagggcccccccaacggaatgatgccggcccccaaagaggctgtgacgggcaacgggattgggggcaagatgaagatagtcaagaacaagaacaagaacggacgcatcgtgatcgtgatgagcaaatacatggagaacggcatgcaggcggtgaagatcaagtccggcgaggtggcagagggggaggctcgctcccccagccacaagaagcgggcagccgacgagcgccaccctcctgccgacaggacttttaaaaaggcggcgggcgcagaggagaagaaggtggaggcgccgcccaagaggagggaggaggaggtgtccggggttagcgatccgcagccccaggatgccggctcccgcaagctgtccccgaccaaggaggcctttggagagcagcccctgcagctcaccaccaagcccgacctgcttgcctgggacccggcccggaacacgcacccgccctcacaccacccgcacccgcacccccatcaccaccaccaccaccaccaccaccaccaccacgccgtcggcctgaatctctcccacgtgcgcaagcgctgcctctccgagacccacggcgagcgcgagccctgcaagaagcggctgactgcgcgcagcatcagcacccccacctgcctggggggcagcccagccgctgagcgcccggccgacctgccaccagccgccgccctcccgcagcccgaggtcatcctgctagactcagacctggatgaacccatagacttgcgctgcgtcaagacgcgcagcgaggccggggagccgcccagctccctccaggtgaagcccgagacaccggcgtcggcggcggtggcggtggcggcggcagcggcacccaccacgacggcggagaagcctccagccgaggcccaggacgaacctgcagagtcgctgagcgagttcaagcccttctttgggaatataattatcaccgacgtcaccgcgaactgcctcaccgttactttcaaggagtacgtgacggtgtagccggagggcgtcggaaggggaagcgccattcccgcgggggggcggggagctgagcacctggggcctcggggcgggctcccctctcgccaacccgccaaccgcgagagacccaggctggcccccagggtgaggacgcccggagcggaggtaaccatgttccccctgcggcggctgtcagacctgggcggaggccccttccacgcggtgccggcggggctcgccctctcctgcccttccccgctggagatggacccccggaacggacagggcagctctgcgcccggcctcagagttctagtattatattttaaccgtgctaacttgtcaagtgctgactctactcccgtttgtacgtggtgttattattgaaatgtattgtttgagctcaaaaggcccgaccaccccccttcgggctgctatatatatatttatttgtaggtatttatatattgaaatataaaaacctagatttatggagtttcctctagatcatgttatattctatatcagacaaactattttcttttgacctttcttcccctccatccagtatttcggttgatttcattttctcccctctcttccccttccacgaactgcaataccagtaaccttggtatatattttttgatactgtacacatggatgtcttgtttctatgtgcaaaaaaaaaaaaaaaaaaaagtttgttaaaaggctacacgagctctctagaaactgctgctactagaaatgtctaaactataagcttccaactattacctgcttgaatgtaaatattaaatggagatgttgaaggtgca

SEQ ID NO: 486 - DNA, 1218 bp, Homo sapiens
atggactctcttgttacagcaaacaccaaattttgctttgatctttttcaagagataggcaaagatgatcgtcataaaaacatatttttctctcccctgagcctctcagctgcccttggtatggtacgcttgggtgctagaagtgacagtgcacatcagattgatgaggtactacacttcaacgaattttcccagaatgaaagcaaagaacctgacccttgtctgaaaagcaacaaacaaaaagctgggtccttaaacaatgagagcggactggtcagctgctactttgggcagcttctctccaaattagacaggatcaagactgattacacactgagtattgccaacaggctttatggagagcaggaattcccaatctgtcaggaatacttagatggtgtgattcaattttaccacacgacgattgaaagtgttgatttccaaaaaaaccctgaaaaatccagacaagagattaacttctgggttgaatgtcaatcccaaggtaaaatcaaggaactcttcagcaaggacgctattaatgctgagactgtgctggtactggtgaatgctgtttacttcaaggccaaatgggaaacatactttgaccatgaaaacacggtggatgcacctttctgtctaaatgcgaatgaaaacaagagtgtgaagatgatgacgcaaaaaggcctctacagaattggcttcatagaggaggtgaaggcacagatcctggaaatgaggtacaccaaggggaagctcagcatgttcgtgctgctgccatctcactctaaagataacctgaagggtctggaagagcttgaaaggaaaatcacctatgaaaaaatggtggcctggagcagctcagaaaacatgtcagaagaatcggtggtcctgtccttcccccggttcaccctggaagacagctatgatctcaattccattttacaagacatgggcattacggatatctttgatgaaacgagggctgatcttactggaatctctccaagtcccaatttgtacttgtcaaaaattatccacaaaacctttgtggaggtggatgaaaacggtacccaggcagctgcagccactggggctgttgtctcggaaaggtcactacgatcttgggtggagtttaatgccaaccacccttttctctttttcattagacacaacaaaacccaaaccattctcttttatggcagggtctgctctccttaa

SEQ ID NO: 487 - DNA, 5518 bp, Homo sapiens
atgctgaggatgaagctgccgctgaagccaacgcaccccgcggagccgccgcccgaggcggaggagcccgaggcggacgcgcggccgggcgcgaaggcgccttcgcgccgccgccgcgactgccgccccccgccgccgccgccgccgcccgcgggcccgtcgcggggccctctgccgccgccgccgccgccccggggactcgggccgcctgttgctggtggagcggcggcgggggcgggtatgccgggcggcggcggggggccctcggcggcgctgcgcgagcaggagcgggtatacgagtggttcgggctggtgctgggctcggcgcagcgcctggagttcatgtgcgggctgctggacctgtgcaacccgctggagctgcgcttccttggctcgtgcctggaggacctggcgcgcaaggactaccactacctgcgcgactcggaggccaaggccaacggcctctcggacccggggccgctggccgacttccgagagcccgcggtgcgctcgcgcctcatcgtctacctggcgctgctgggctcggagaaccgggaggccgctggccgtctgcaccgcctgctaccccaggtggactcggtgctcaaaagcctgcgcgcggcccggggcgagggctcgcggggcggcgcggaggacgagcgcggcgaggacggcgacggcgagcaggacgccgagaaggacggctcaggcccggaaggcggcattgtggagccccgggtcggcggcgggcttggctccagggcccaggaggaactgctgctgctcttcaccatggcctcgctgcacccggctttctccttccaccagcgggtcaccctgagggaacacttggagaggctccgcgccgcgctccgcgggggccccgaggacgcggaggtggaggtagagccgtgcaagtttgccggccccagggcccagaacaactctgctcatggtgattacatgcaaaataacgagagcagcttaatagagcaagctccaatacctcaggacggacttaccgtggcacctcacagagctcagcgagaagctgtacacattgagaagataatgttgaaaggagtccagagaaaaagagctgacaaatactgggagtacactttcaaagtaaattggtctgatctttcagtcacaacagtaacaaaaacccaccaagaactacaggaatttctactgaagcttccaaaggaactgtcttcagagacttttgacaagaccatcttaagagccctgaatcagggttccttgaaaagggaggaacggcgacatcctgacctagagcccatcctaaggcagctattttcaagttcatcacaagcttttctacaaagtcagaaagtacacagcttctttcagtccatatcatcagactccctacacagtatcaataacttacaatcctctctgaagacttctaagatattagaacacttaaaagaagacagctctgaagcttcaagtcaagaagaagatgtgttgcagcatgccataatccacaagaagcatactgggaaaagtcccattgtgaacaatattggtacaagttgttctccattggatgggcttaccatgcaatattctgaacagaatggaattgtggattggaggaagcaaagctgtaccaccattcaacacccagagcactgtgtgacctcggctgaccagcattctgctgaaaaacggagtttatcttcaataaataagaagaaaggaaagccacaaacagaaaaggagaaaattaagaaaactgacaacagattgaatagtagaataaatggtattagactctccactcctcagcatgcccatggtggtactgtgaaagatgtgaatttggacattggctctggacatgacacatgtggagaaacatcttcagagagttacagttctccatctagtccccgacatgatggaagagaaagttttgaaagtgaagaagagaaagacagagacacagacagcaattctgaggattctgggaatccatcaacaactaggtttacaggttacggttctgtcaaccagactgtcactgtcaagccacctgttcaaattgcttcactaggaaatgagaatggaaaccttttagaagatcccttaaactcacccaagtatcagcatatttcttttatgccaacgttacactgtgtcatgcacaatggtgcccagaagtctgaagttgtcgttcctgcacccaaacccgctgatggcaaaaccatagggatgcttgttcctagtcctgttgctatttctgcaataagggagtctgcaaattcaacccctgttggaatactagggccaacagcttgcactggagaatcggaaaagcaccttgagttactggcttcccctttacctattccatcaaccttccttccacacagtagtactcccgctttgcatcttacagttcagaggctaaagttgccaccaccacagggatcttctgagagctgcacagttaacatcccacaacaaccacccggaagcctgagcatcgcatcaccaaacactgcctttattcctatccataacccaggtagtttcccaggctctcctgttgctaccacggaccccatcacaaaatctgcatcccaagtggtaggactcaatcaaatggtgcctcaaattgagggaaacacagggacagtccctcagcctaccaatgtgaaggtagttcttccagcagctggcctctcagctgctcagccaccagcttcctaccccttaccaggctctccccttgctgccggcgtgttacccagccagaactccagtgtgctcagcacagcagcaacttctccccagccagcgagcgcaggtatcagccaggcccaggcaactgttcctcctgcagttcctacccacaccccaggccctgccccgagcccaagccctgccttgacacacagtaccgcgcagagtgacagcacctcttacatcagtgctgtggggaacacgaacgctaatgggacagtagtgccaccgcagcagatgggctcaggtccttgtggttcttgtgggcgaaggtgcagctgtgggaccaatggaaaccttcagctaaatagttactattatcctaatccaatgcctggaccaatgtaccgagtcccttcattctttactctgccatccatttgcaatggcagctacctcaaccaagcacatcagagcaatggaaaccaacttcctttttttctgcctcagactccatatgcaaatggactggtacatgacccagtcatggggagccaagccaactatggcatgcagcagatggcaggatttgggagattctatcctgtatatccagcacctaacgtagttgccaacaccagtggttcggggcccaagaagaatgggaatgtctcatgttacaattgtggtgtaagcggacactatgcacaggactgtaagcagtcgtccatggaggccaatcaacaaggcacttacagactgagatacgcacctcccctccccccttctaatgatacgttggattctgcagactgaaacgagtaaagcttgcctacttaatacactcaagtgtggggagtcatggggtgtggaggggaggaaaggaaaggtattttgtttctttgtctatacatttcctagatttctatgcagttgggatttttcatttctcttgtaccaatgtccaaaacaagaaagaatgcaatgcttttgagcctctggtctcctggttcaacaacaggcttatatgtatgatacatgtaatttaaaccttcagacaaacttaaatgttggtgcgtgcttttttttttttttttacactgaatacttgctgtgtgcaatgtttactgaatctttaaaactgtgtatttgaccttttttttacaacactggtgacagtcatatggttttgaaaaaaaaaagaaattttgcttcttcccagcttttctcactttcaccctaaacgacacttcctccccagccagcctcactctgtctccggcccgcagcaggagcagccagcagtgcattcaccccacttttgtaaactgctctgcatataaaccaagggcagaatgtttcaccctgatcttatgggaggaatcaaactcccaaaatagtgtgtatatatgtaataaacagcgtcacgtaaatacatatatgcagtgcttgttgtccaaatagaaatgaaaataagtggaagagagaggaagaagtcaaaccatatgaaactgaaaaaatatgacgtacgaaatggacaaaaagctttttctgaaaccaactttttacttccatcatccttttttagcctgttgcttcagagagacacaaagtgaacacactggtgtgaatgtcgctctctgtgtgcttgtgtttgtaatgaaagtctacagccaattttacttgtctaccaccgtgttgtgctcaaagagacactacttgagtgaagatttcttctttccctgtaccagctgttacagtgttacgttgtgtttaaaatgtgtatggtttattgcaatctgaacagagctatgggtttctaccataagtcaggttgtttgttccctaacctgtctctcatagcaaagtcacttttataacagtttaccactatgcttgattataatgtgaaaggcggaattctgagtgtgttaagatggtattaatcatgtcggtgtcatgtcactaagtttaatgctgctgtttttaaaaaaaaaaaaaagtttttttaaaaagccaatctatgtactaaattgcttccaggtaatttttgatttcctaaagtgcactgaggttatctggaagattgggtgtattttttggtgactgctgcattcatcagcaatgaacagtttccactgtatagtcctaggggtcagggggtgggggtttcattttccattcctcagcacagagcagaaatgatagatttttattgtttggagtaacgttggtatgcagcagaggaacgtaaacatttggtcttggttcagaagcctaacagattgctagacaagagaaaaaacttgaagaaaaaagaagcttaatttcatgcttcataagtagcatttatatttatagcaccaatgtacattttgaaactttctttcaggggtgggagttatggggaaggggtgggtgtgaaggggtagatgaaagctttaatttagaaagaaagttcaagtaaaggaaattattttgattaaatatattttatttgatctgggtatttttggaccacattattaaattaattgttaagctgcagttgagttgttcaagtgagagttttgataagccacttatgggccgcgttgtgaatcacttgccagttgtactttatggagcttattttatgatttaaaatactgtactgtacataggaggtatgttaccttctccttatttgtatgtttaccatatactttgatatttgaaatgttatgtactggaaaggccacttatatttctagaacagattggattttatgcaaccttttttccttgaattaacagc

SEQ ID NO: 488 - DNA, 1262 bp, Homo sapiens
cgtgtgtagttggcatctccgcgcgtccggacacccgatcccagcatccctgcctgcaggactgttcgtgttcagctcgcgtcctgcagctgtccgaggtgctccagttggaggctgaggttcccgggctctgtagctgagtgggcggcggcaccggcggagatgcctgggaagaaggcgcgcaagaacgctcaaccgagccccgcgcgggctccagcaggaccggcgggtacggcgggtacggcgagggaccaagccggatttgcgattgggatgcagctgcgtttcaccaggggcaaaaagctcctttcctcctctctttcctcctcgccacttgcccttccccggggccacgaggaacaagtgcaagtagctggaagtcgagtgtgctactcaactcaggagatttggagacaaactgaacttccggcagaaacttctgaatctgatatccaaactcttctgctcaggaacctgactgcatcaaaaacttgcatgaggggactccttcaaaagagttttctcaggaggtgcacgtttcatcaatttgaagaaagactgcattgtaattgagaggaatgtgaaggtgcattcatgggtgcccttggaaacggaagatggaatacatcaaagtgaatttctgttcaagttttcccagattatcattctttgggatgagagaacattataaaaccactttgtttattttaaagcaagaatggaagacccttgaaaataaagaagtaattattgacacatttcttttttacttagagaatcgttctagtgtttttgccgaagattaccgctggcctactgtgaagggagatgacctgtgattagactgggcggctggggagaaacagttcagtgcattgttgttgttgctgtttttggtgttttgcttttcagtgccaactcagcacattgtatatgattcggtttatacatattaccttgttataatgaaaaaactcattctgagaacactgaaatgttatactcagtgttgatttcttcggtcactacacaacgtaaaatcatttgtttcttttgactcaaattgtattgcttctgttcagatgatctttcattcaatgtgttcctgttgggcgttactagaaactatggaaaactggaaaataactttgaaaaaattggataaagtataggagggttacttggggccagtaaatcagtagactgaacattcaatataataaaagaacatggggattttgtataaccagggataataaaaa

SEQ ID NO: 489 - DNA, 1421 bp, Homo sapiens
aggcgggaggcgacgcctgcgcagtgcggtcgcggggctgtcgttgtcccgcgagccgccgaccaggcctcgaacgggatggcagaggaggtgagcaccctgatgaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcacacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctcatacacacatacaacaagaacagctctgcgtgtgagaactctggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaggacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaatttttaaaatgaaaaaaaagctgctctgattcaggggatgtgggtgggggtagaacctggacctcttggccctgggggcacatgggatgcttctaggaacacagtttgagaaccacc

SEQ ID NO: 490 - DNA, 3844 bp, Homo sapiens
agccattttgttccgcccgaggagaccctaagatggcggcgagggggacggtgaaggttgcctcccgcccgtccgggctctgatcctccgtctccccgtcccccggcggccggcccatggcctggcggaggcccgaaccatggacctccgcaccgccgtgtacaacgccgcccgtgatggcaagctgcagctgctccagaagctgctcagcggccggagccgggaggaactggacgagctgacgggcgaggtggccggcgggggaacgccgctactcatcgccgcccgctacggccacctggacgtggtggagtacctggtggaccggtgcggcgcgagcgtggaggccggtggctcggtgcacttcgatggcgagaccatcgagggcgcgccgccgctgtgggccgcctccgcagccggccacctggacgtggtgcggagcctgctgcgccgcggggcctcggtgaaccgcaccacgcgcaccaactccacgcctctccgcgccgcctgcttcgacggccacctggaggtggtgcgctacctggtcggcgagcaccaggccgacctggaggtggccaaccggcacggccacacgtgcctcatgatctcgtgctacaagggccaccgtgagatcgcccgctacctgctggagcagggcgcccaggtgaaccggcgcagcgccaagggcaacacggccctgcatgactgcgccgagtccggcagcctggagatcctgcagctgctgctggggtgcaaggcccgcatggaacgtgacggctacggcatgaccccgctgctcgcggccagcgtgacgggccacaccaacatcgtggagtacctcatccaggagcagcccggccaggagcaggtcgcagggggagaggctcagcctgggctgccccaagaagacccctccaccagccaggggtgtgcgcagcctcagggggctccgtgctgcagctcctccccagaggaaccactgaacggggaatcttacgaaagctgctgtcccaccagccgggaagctgccgtggaagccttggaattgctgggagctacgtatgtggataagaaacgagatctgcttggggcccttaaacactggaggcgggccatggagctgcgtcaccaggggggcgagtacctgcccaaaccggagcccccacagctggtcctggcctatgactattccagggaggtcaacaccaccgaggagctggaggcgctgatcaccgacccggatgagatgcgcatgcaggccctgttgatccgggagcgcatcctcggtccctcgcacccggacacttcctattacatccgttacaggggtgccgtgtacgccgactcgggcaatttcgagcgctgcatccgcttgtggaagtacgccctggacatgcaacagagcaacctggagcctctgagccccatgaccgccagcagcttcctctccttcgcggaactcttctcctacgtgcttcaggaccgggccgccaaaggcagcctgggcacccagatcggctttgcagacctcatgggggttctcaccaaaggggtccgggaagtggaacgggccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcacccctctgcacatggctgtggacaaggacaccacaaacgtgggccgctatcccgtgggcagattcccctccctgcacgtggtcaaagtgctgctcgactgcggggccgacccggacagcagggattttgacaacaacaccccgctacacatagcagcccagaacaactgcccggccatcatgaatgccctgatcgaagcaggggcccacatggacgccaccaatgccttcaagaagacggcctacgagctgctggacgagaagctgctggccaggggtaccatgcagcccttcaactacgtgaccctgcagtgccttgcggcccgggccctggataagaacaagatcccttacaagggcttcatcccggaagatctggaggcgttcatcgaactgcactgacctgcccagaacgcctgcaccctcacctctcccctctcctgctgagatgggggaaatccggctgcggcatagcagatgctcgttcttgcctccttcaggcaccaatcaggagaagggttctgcctcccatcccctctacctgcagacagggtcggaggtgttagcgagcctttggtgctagaagcctgcggggtcatgtgctaagaggacagtctttctccgggagcccgctcactcattctgagttaggaaaagacacaagaccttccccacatcctgtctgcctgggttagggaggcctttgccttgttacctagaggcggagggactgaagccattgcgttccttccctgctagaaacacaggaagaagttgaggactgtctgccttccctcgtccctttacctggccagataactccagccgctgaatacagtgttaggactgggggctcctgagatgagagtttgagattcagggaatgagaccacctctcatttcttccagcatgatcgcgccctgctcccgtgccaccgtagtccctggcagacaggcagggctctgcccagggcagcctgccacttgcatagctttcggttggtttggtgttctgtttatttaataagtgggcaggttgcaagcgttgcacagaaattctgagattttactgcctttttttttttttttaagaaagttgtttgttggactccataagtgaatttcaagcagtgaggattttgtggtgcctgagatggccgagggcacagggagtgagctgtatgtgtgaggaatttggtgagcgagataaaagtccacggtgtcaacccctaaaacatgggtgaccgtacatttttatacatctccactctacggccttttacaggctttccgattttacaggcctttccaagtttccattctccttagagagagaactgtgcttccaaacagaaatcaggagtgaccacaaagcctgaaaacactttgccacccagcaaagaactggcacaattggtttgggtctgcattgccatagtgcccgagttaaaactgcaggccactctgccttgcagtggcctctgatttcattgtgggtgcatccacaggtggcccgagctgttctttcagctgctccaaggattgagacccaagtcatcatgaaaaaggcccaagtacagtcttaatgcgataaatccactagctaagacgtcgagtgccaagaccagccttccagccgaggtttggacaaagtctcaggttcccgtgactcagggtaaggtgctggggctgccagaggacctgccccagcaagatttttgtcaagagcgagactccatcagcccaggcagacgggagcaggttcttggccagcgtagacagcagcaaacagcagcagggaagccattctcactgcatcctccctgcagtagccacggccaggcccttaggaggagcagtgaccgggggtgtccagaaatatcctgtccctggatggaaactaggtctcgtttggatttttttttttttttgccgtgttaggaaattatttattaatttacaagacaggttttaactcagccgaggtgggaaatggtgtccctgtccctcccaaagcacagagcacagaaatgaggccgtttacatggcgagtctccgtgctggtgtttaagtcattaaaaagatactcaaagagaa

SEQ ID NO: 491 - DNA, 852 bp, Homo sapiens
gtgacagagcgctttacgacagttgctttgaggcagtaccggaggagaaagatggcggctaccttactagctgctcggggagccgggccagcaccggcttgggggccggaggcgttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataagagatgccctgtactgatgcaaaatttaataaagtttgtcacagagaatctttgta

SEQ ID NO: 492 - DNA, 1665 bp, Homo sapiens
gttgcagcctgctgcgcgcccaggggtcccgcgggttttcgggcgcagggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggcattttgatacggacacccaggatctcacagggattgagtgggccccaaacggctgtgtgctggcagtgtgggacacctgcttggagtacaagattctgctgtactcattggatggccggttgttgtccacgtacagcgcttacgagtggtccctgggcatcaagtctgtggcctggagccccagcagtcagttcctggcagttgggagctatgatggaaaggtgcgcatccttaatcacgtgacttggaaaatgatcacggagtttgggcatcctgcagccattaatgatcccaagatagtggtgtataaggaggccgagaagagcccacagctgggactgggctgcctctccttcccgccgccccgggccggggccggccctctcccgagctcagagagtaaatatgagatcgcctctgtcccagtctccttacagacactgaaacctgttaccgacagagcaaacccgaaaatcggcataggaatgctggcatttagtcctgacagctacttcctggcgacaaggaacgacaacattcccaatgccgtctgggtctgggacattcagaagctgaggctgttcgcggtgctcgagcagctgtccccagtgcgcgcatttcagtgggacccgcagcagccgcggctggccatctgcacgggaggcagcaggctctacctgtggtccccagcgggctgcatgtcggtgcaggtgcctggggaaggcgactttgcagtgctctctctgtgctggcatttaagcggagactcgatggccctcctcagcaaggatcacttctgcctctgcttcctggagacagaggcagtggtcggcacagcctgcagacagctgggcggccacacgtagcagcggtgcactaacgtgtgcagaaacagggctactctgtgtttccagtgtgggaaaaaacacagcttcaccaggaggttctccactgtggtggtctggattcagtgattgattctatttttctatagcaaagcatttttgtaaatatgtatggtataaaactgtagttttattatttaaaataaatacttgctgatttatacaacta

SEQ ID NO: 493 - DNA, 1655 bp, Homo sapiens
cctggaccagggggacatctgagaagcatgatgttgagtgccagacagctaggtctccaaagttgggctcgttgctggagtctgccccctcaaccgctgaattcttgctgggagtagtagcagtttgggaatgccatctgcagcatggagctggggttgagcttggaccaccccaagacctggggtggatcttaagggtcagcttgagcctaggctctcgagtcctgacatcatcctctaccgccacgctttccagctgtcagccttggtctccatctggttccttgagggtgtggcctctgcgtcctgctatcacccttccttgtctaaaccttcccacctgagtggagaggaacttgggggaaaatctctaagcatgggctcttcctgctgtcctatgcttcctatcccctagggttagtggtgcgtgttgggtggtggagcgagggatcccttggagcaaggttcttagagaactttgggtctgaaagcagctcaaaccttccaaagccccaagcttccctgtgctattagagcacctcctcctggagagagcggctctcgtggctggggagttggatgcaccaaacctgtgtgcggctggagagggaggcttctgccagaccctctcccgggcctgtcctgccacccaggcccctccccagtctcacactgagctccagatcagggaagggccgaaaaggacgatcagggcagccgcagaaggggcgccctgcgtgggacgggtccgttgcgcgcctggtaaccgagggggaagggaaggggcctctggcgtgcggggcggtgtcgcgcaggtcccaccccgcctgcccgcgccgcccattggtcccgagcgcgatgacttggcgggcggagcaggaaggaaaccgctcccgagcacggcggcggcgtcgtctcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttcca

SEQ ID NO: 494 - DNA, 5897 bp, Homo sapiens
gcccccgccgggcggctgagggggcggagcctcagccgctgtggatggggagtggaggcggaggggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaatccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaggtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccattttgtatttttttaagtagaaactgagtagtttggatttttatggctcacatctttttactgaagccagaaaggcacctcaaagatgtctcaagctcagcagtcaccgtcatgttgtgatgaagaaagcgaatcaccaggtggtgatttgctatctatttgagaactagaatcactcaacactcattttgaattatgcagaagtggttcatgcagatttttattccagatgaacatgttttaaaagtgcctgaaatatgactgccatatgaatgtgattctgcagcaaaaaacacaaaatagatcatttaattacagaaaatgagatcctctgtgaattctgaatgttaaaaaccaacactgcttttaatcctcttttaatgttttaatacaagctttgtgttctgaaacaaggctgcataagtagaatgggaatccttctaaaggtgggtgtgaactcaccacaagctgagctttatagagcccttgagaaaccctcctgagcactaagcagttggggtgctgattttcttgtacttttgaaaaattaagtcactcccagtttcctgcataagttcttgaacagaatgaaatcacatctccattcaaaaaatgtctcaagcatctactgttgtgtaaggaacttctgattctgattgctgttacttgaataggaaatggttactcattctgtataaaagttttgcaagagaatgaattttttattctgtaatcaaaaagcaataacttgaaattcactctgtaatattataggtcagtcagaattatacaagttttaccaaattgttacacttattctccaagctgccagaacctggtatctgtatctgtaaaaccaaattaacttttgcttaaatgggaagtatacatatatctgtatagatacattacccctttacatgtttaacatacacacacttaaacacataaatactagtgtgattatatctttggagtttgcaatatagcataaaggacaagtagaactgcacattaagattacctaccgaagcaactagatgtggctgggacacaatcaaaggaggaattttgtccacaggaaggtgaggaaattccaaatgaagcctagatcttcagtatcataaaaaggcagagctggccaggcacagtggctcatgcctgtaatcttatcactttgggaggctgagatgggaggatctcttgagaccaggtgttcaagaccagcctcatcaacatagtgagaccccatctctattaaaaaaataaataggcagagctaaactaaccccagtgtcacaaaactcaactggtcatataaatgagtgaaacaggcctctcacacaagcgatgtaaaacagctgggagcagtgggagctgtggcaaactaaagtgcccaagccgcatttaaaaagggcatctgttcagctccatctgcttgctgcggtgcaagaatgctaaaccaggattaccagttcttcacattttttgaaatccaaattttcatgagaaacattctcatttttaaatatcaagaagtgattttaaaatgtttaaatggtgctggttaaacaaacacgtctgcagctggatttagcttgcaagctgccaagttgcaacctctttcattctagaaacttctgtcattttcatcatagcaagtctatgcggacaaaagcctccaaactttccaactgtgtaggccagtacagctggcaaggttcatagaatataatggctatccccctctgccaaataagactatccacaacccagctcagacacagtggttatatgattttgtgtccatacaggagaggccttggtgtcttcacatacattctctgagccaacatctatccagcagccctgacctcctgctataatttaagtctatttccttttaatctaataagagttgatagtaaaaaggcaggtgatggaaatcagtgtataaatcacaatggagtatattggcaactccacagcttatagtttgataaaggcaaatacatgaaaaataaaaatgctactaatgccccaaggtgtctatcaaaatgatgtagggggtatcttaaactgtccaaggcaatcatgcattgaactttattcctatgcagagccaaaacgaatagtgttgataaaatagctaaactttctaaactggagaggaggctacagtgccagagagttattgtctcttttgctttaaatggtaatcttaaaagttgcattgtgctcttcctttgttttgggatagatatatatagagagagatactataaggaagtttatttcttaggaagtgcactgaataatgtatttcttttacagtgtaatatgggggtggggatatgcgaaagaaatgtgtatttttgctagttgcctaccttctgagataaataagcacaatcttgcaatggatccaataacccagttaggtattatagattagtatttaagtttgctgtagattgtgtgtgtgtgtgctaagtaaaagttccatgattcacaattttagtattaacccatgttgcaaaagctgttactggccaacagattgtaatgatgtgtaccatataacacaagcattaactaggcattaacgtttgtaaagccaaatataccatgcagaagtcttcatttttatagcagactgcattaaaacaagttaaatcttgctgtttggggggaaatagtcttgtttgtacaaagtgaaaaatggcacaatttgggcatattttgttgggaagagggggtggtgtagagggagcacttgactgtggctttgacaaaacaaatgaagtcaatgacccatccaggttagactccataaggaactaagacattgattttctttagagtcttagagctggaaaaagcctttacaataatccagtctgtgattttttaaaccttttggtggttctggacctttttgagaatcttagaaaagccatggagtttatccctagaaaaatgaatatgcctatatgcaaaatttgtttgatggcttcataggatccaaagaccctgaagccatccatggctcatgtatttctgcttaagaaagcataatcttgttctgctctctcattttacaaatgattaatgcatcccttttcaactactccagcgctgttgctgctgcaatgttagcaaatgcaagccagagagaagcacttgaaaatcctttgatgtctaaaaaatgttcaaatagtgtggatgtttacatatctgaagttttcagcatttaagcaaattaatgatcatttcaacaaatactagcatatccggtttcccttaatagcctgtcagcagtgctgccttgtcaatttgtgtgtgtgtgtgtgtatgtgtgtgtgtgtgtgaattcataaggagtgcttctgatgcttagtccttgaaatggaacttcaactgtctttcaaaacactggcttcaaaataggatgtgttttcctaatgaatcagaagtgggcaatgagcattgttccacaggaataatttttaatttaatttctataaaactagttgagaaatgagagcctgtccacccaccatttgtgtatcagtggccaattcattagtaaaaataaaggaggggaaaggaga

SEQ ID NO: 495 - DNA, 3471 bp, Homo sapiens
cagattacacttggttgactactccggagcagccactaagagggatgaacaggcctgcgtggaaattgaatgagattcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggatgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcagcaacctgaaacgaacagccagcaaccctaaagtggagaatgaggatgaggagctctcctccagcaccgagagtattgataattcattcagttcccctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggctccctacctgatttatgtggaagtccttgaatgtgaaaactttgacaccaccagtgtccctgcccggatccccgagaaccgaattcggagtacgaggtccgtagaaaacttgcccgaatgtggtattacccatgagcagcgagctggcagcttcagcactgtgcccaactatgacaacgatgatgaggcctggtcggtggatgacataggcgagctgcaagtggagctccccgaagtgcataccaacagctgtgacaacatctcccagttctctgtggacagcatcaccagccaggagagcaaggagcctgtgttcattgcagcaggggacatccgccggcgcctttcggaacagctggctcataccccgacagccttcaaacgagacccagaagatccttctgcagttgctctcaaagagccctggcaggagaaagtacggcggatcagagagggctccccctacggccatctccccaattggcggctcctgtcagtcattgtcaagtgtggggatgaccttcggcaagagcttctggcctttcaggtgttgaagcaactgcagtccatttgggaacaggagcgagtgcccctttggatcaagccatacaagattcttgtgatttcggctgatagtggcatgattgaaccagtggtcaatgctgtgtccatccatcaggtgaagaaacagtcacagctctccttgctcgattacttcctacaggagcacggcagttacaccactgaggcattcctcagtgcacagcgcaattttgtgcaaagttgtgctgggtactgcttggtctgctacctgctgcaagtcaaggacagacacaatgggaatatccttttggacgcagaaggccacatcatccacatcgactttggcttcatcctctccagctcaccccgaaatctgggctttgagacgtcagcctttaagctgaccacagagtttgtggatgtgatgggcggcctggatggcgacatgttcaactactataagatgctgatgctgcaagggctgattgccgctcggaaacacatggacaaggtggtgcagatcgtggagatcatgcagcaaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagccacttgtgtcatttccaggttttctgggggagtgcagggggagatgggtgatgaggtatgaacggatgcctcagtgtccaagatacaaaaggcactacatagaagtttgctttttccctgcctgtcttggtcactaccacctcttccctgagaagggcgggccttccatgttctctcacccgcttcaactccacat

SEQ ID NO: 496 - DNA, 6626 bp, Homo sapiens
ggggggagtcggcgtctctctcccccgcgccagctcccgtacacggagccgcattccttggcccccccacccccctccctcggggcccccccgcccccctcgggaaaaaaatccaccccgaatcactcgaacccgagggaggcttcctttcacccttggggagacgagctttcaacggttacctcttcttcgtctccccccaagcccccgtcccctccccctgctcccacccccttctggcgccgggtgtaaggtccctttaaggcgacggcgccttcctcgggtcagactaccggcggcgacgaccacaggagcatggcggacaccgacctgttcatggaatgtgaggaggaggagttggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttccagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaagtgacctcttccatcccagtatttgacctccaggatggtggacggaaaatatgtccacgatgtaatgctcaatttcgtgttactgaagctttgagaggtcacatgtgttactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcgattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactaccaagtgcaagatctgtgaatgggcgtttgaaagtgagccactatttctccagcatatgaaggatactcataagcctggagagatgccttatgtttgccaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgagtgtcatgggccggcagacatgcctggagtgcagcttcgagatcccagacttccctaatcatttccctacttacgtacactgctctctgtgtcgctatagcacctgctgttctcgagcttatgccaaccacatgatcaacaatcatgttccacggaagagccccaagtatttggctttgtttaaaaattctgtgagtggaatcaagctggcctgcacttcatgtacctttgttacctctgtgggcgatgctatggccaagcatttggtattcaacccctctcacagatccagcagcatcctgccacggggactcacttggatagctcactcaaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgagggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtt

SEQ ID NO: 497 - DNA, 1902 bp, Homo sapiens
actcctcacaccacttaacagccacttgtttcatcccacctgggcattaggttgacttcaaagatgcctcagttactgcaaaacattaatgggatcatcgaggccttcaggcgctatgcaaggacggagggcaactgcacagcgctcacccgaggggagctgaaaagactcttggagcaagagtttgccgatgtgattgtgaaaccccacgatccagcaactgtggatgaggtcctgcgtctgctggatgaagaccacacagggactgtggaattcaaggaattcctggtcttagtgtttaaagttgcccaggcctgtttcaagacactgagcgagagtgctgagggagcctgcggctctcaagagtctggaagcctccactctggggcctcgcaggagctgggcgaaggacagagaagtggcactgaagtgggaagggcggggaaagggcagcattatgaggggagcagccacagacagagccagcagggttccagagggcagaacaggcctggggttcagacccagggtcaggccactggctctgcgtgggtcagcagctatgacaggcaagctgagtcccagagccaggaaagaataagcccgcagatacaactctctgggcagacagagcagacccagaaagctggagaaggcaagaggaatcagacaacagagatgaggccagagagacagccacagaccagggaacaggacagagcccaccagacaggtgagactgtgactggatctggaactcagacccaggcaggtgccacccagactgtggagcaggacagcagccaccagacaggaagaaccagcaagcagacacaggaggccaccaatgaccagaacagagggactgagacccacggtcaaggcaggagccagaccagccaggctgtgacaggaggacatgctcagatacaggcagggacacacacccagacacccacccagaccgtggagcaggacagcagccaccagacaggaagcaccagcacccagacacaggagtccaccaatggccagaacagagggactgagatccacggtcaaggcaggagccagaccagccaggctgtgacaggaggacacactcagatacaggcagggtcacacaccgagactgtggagcaggacagaagccaaactgtaagccacggaggggctagagaacagggacagacccagacgcagccaggcagtggtcaaagatggatgcaagtgagcaaccctgaggcaggagagacagtaccgggaggacaggcccagactggggcaagcactgagtcaggaaggcaggagtggagcagcactcacccaaggcgctgtgtgacagaagggcagggagacagacagcccacagtggttggtgaggaatgggttgatgaccactcaagggagacagtgatcctcaggctggaccagggcaacttgcataccagtgtttcctcagcacagggccaggatgcagcccagtcagaagagaagcgaggcatcacagctagagagctgtattcctacttgagaagcaccaagccatgacttccccgactccaatgtccagtactggaagaagacagctggagagagtttggcttgtcctgcatggccaatccagtgggtgcatccctggacatcagctcttcattatgcagcttcccttttaggtctttctcaatgagataatttctgcaaggagctttctatcctgaactcttctttcttacctgctttgcggtgcagaccctctcaggagcaggaagactcagagcaagtcacccctttgtactgaattgtcctcatcttgtggggggtttcaggactatttttatctctgacatctctctattgccccatctaccctaatgcatcaataaaaccttaagccactgg

SEQ ID NO: 498 - DNA, 2123 bp, Homo sapiens
cctatccaggtgagaactggccactctaatttacccggaagcctttctgcaggagattcaaatatttgctaatgcttactgacaccttcactggttagatcgaggcattccccaccccatctgaaaaatgtttaccagaagaaataactcctcagtttgggtaatccaaaagcctgcaaagtgacaatggcccatctttcacagcaggcgtatcccaaaacctgtcctcagctttaagaatccaatatgaccttcactctgctggagaccacagtcctctggaaaggtgaaagggctaaccctactctaaagaagactccagctaaatcagaggcctgactgtctctaacacccatagcttattgtgggttagaactgctccaaagtaaaacgtataattgagtcctgttgagttcacatgtggaaggcctttcctaaccacagatctcctaatagatgaaaagactcatcaattacaaaaatatgtcatcaatctaggacaggtgcaaaggcactccgtgcatatggaaacaagagtcttcccctcccacatgggaggaaaattcagtttcagctcagctagggatttagtcttactaaagacgcgggaggaagttctccagcgagcagctttccccaacgtggaaaggaccacgcaaggacacctgagctttccaacagatgttcagcgccaggggatccacagttctgggaggtgatctctgatgaacatgccatcgactccgctggcacctaccacggggacagccacctgcagctggagcgcatcaacgtgtactacaacgaggccagcggtgagacccccgtccttcccccaccgccctcctgggaacgcggccctcccctcgctcatgccctcccgccccacgcaggtggcaggtcagtgtggggccggaaacaactgggccaagggacactacaccgaaggcgcggagctgatggagtcagtgatggacgttgtcagaaaggaggctgagagctgtgactgcctgcagggtttccagctgacccactccctgggtggggggactgggtctgggatgggtacccttctgctcagtaagatccgggaggagtacccagacaggatcataaacacattcagcatcctgccctcgcccaaggtgtcggacaccgtggtggagccctacaacgccaccctctcagtccaccagctcatagaaaacgcagatgagaccttttgcatagataacgaagctctgtatgacatatgttccaagaccctaaaactgcccacacccacctatggtgacctgaaccacctggtgtctgctaccatgagtggggtcaccacgtgcctgcgcttcccgggccagctgaatgctgacctgcggaagctggccgtgaacatggtcccgtttccccggctgcatttcttcatgcccggctttgccccactgaccagccggggcagccagcagtaccgggccttgactgtggctgagcttacccagcagatgtttgatgctaagaacatgatggctgcctgtgacccccgtcacggccgctacctaacggcggctgccattttcaggggtcgcatgcccatgagggaggtggatgaacaaatgttcaacattcaagataagaacagcagttactttgctgactggctccccaacaacgtaaaaacagccgtctgtgacatcccaccccgggggctaaaaatgtcagccaccttcattgggaataatacggccatccaggaactcttcaagcgtgtctcagagcagtttacagcaatgttcaggcgcaaggccttcctccactggtacacgggcgagggcatggatgagatggaattcaccgaggccgagagcaacatgaacgacctggtgtctgaatatcagcaatatcaggatgccacggccgaggaggaggaggatgaggagtatgccgaggaggaggtggcctagaactctccttttctaggtaaaggggggaagcagtgtggattctttactgtgttctgacagccatgtgtcactatacgcttgttaatttgtgtcttcacatctcctgctgcgttttaaagcatttttatagtatgcggttttgactaataaagtattctcacagca

SEQ ID NO: 499 - DNA, 5045 bp, Homo sapiens
attttctctggcttgtgtttctgacagtgttagggcctcctaaagcttcctaggcataggggtatgcctggcttgaattttaaccagggactcagtccagattatggggagacccgaggaaaagtgctgggtagaagaccaaaaaacaaagaccctcagagtgaaaagggcctctagacatcatcccttccaacatctcccagtgcctggagccctcctgcgccacgtgtgtcagatggccggagagcctctgctcgaatacctctttgatggggagctcaactttttaaaagccaccagttgcatcgtaagccaactcttgccattagaagatccttcttatgccagacggaaaaccgctctctggaactttctcccctggctcattctgacccctggagcaccagggcatacgtctgctctcttgcttacacggcagcccttcagacatttgtgacagctctgtgtcctgctaagatgtctcttctctgagctgaagatcccttgactctttgggcccactgggtgtgagctgggggtctcagtcctcagggcctgtcttttctctcccccatcaccgctcaaggtcgcacatgggcagtgcagcagacgtgcggttctccctgggcacaaccacacacgcacccccaggcgtgcatcgccgctactcggcattgagggaagagtctgccaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacagacagtgaggagggcagctgggctcagaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatggtccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccccattctcccacaggatggtgaggctgggaggaggaagactgaggtagagattccaggccctggcataagctgaatcccaaatttgagtttgggaagaaccagagagaaatggatccctgagctctgagccaagggtgaggatggggaaactctaagctcccacctaataagaagcataggcagaccagccagagggagagccaatggcctctggtagccttaagcccaaagggcagtgggaatgtcccctgccccaaccatcgggtggagctcctgctgggctatggggaagggaggttgtgcggatcttgactctagggcagaacagatctaaccatgcattgctagctctgctcccagcatcccttccccttctctcctcctctgcctcacttctttagtaatcccaaccctataaaaatgaacctaatgggtggattgaatatacattgagcccaaagtcaagtttggggaaaaggcagactaaggcctcctttctctgacctcccaggaagaaaatagcttctcctacagtgattcatgtcccaggtccaggaaatccaatgttggtgaaggcagccactctcttgcttgtccccaaatcacctaaccctcatccagggctattttggtgggcagggactgcctcctcccggaattcctaagatccgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaactctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagacaatgta

SEQ ID NO: 500 - DNA, 2484 bp, Homo sapiens
gacgagccaaggaaaaaaagtacaagtgtggctgcaaagtttgcccctcttgttaccctcaggcaaatgattgatttagaaaggccccaggggctattttttgcaggaacggtcactccctaaatccaggcagggaaagggaggagtctgagccgagtcacgccccttctcctgtaaacttgggtcgcctctagcttagcgagcgctggagtttgaagagcgggcagtggctgcacacgccaaactttccctatggcttcggtgaccagggccgtgtttggagagctgccctcgggaggagggacagtggagaagttccagctgcagtcagacctcttgagagtggacatcatctcctggggctgcacgatcacagccctagaggtcaaagacaggcaggggagagcctcggacgtggtgcttggcttcgccgagttggaaggatacctccaaaagcagccatactttggagcagttattgggagggtggccaaccgaatcgccaaaggaaccttcaaggtggatgggaaggagtatcacctggccattaacaaggaacccaacagtctgcatggaggagtcagagggtttgataaagtgctctggacccctcgggtgctgtcaaatggcgtccagttctcgcgcatcagtccagatggtgaagaaggctaccccggagagttaaaagtctgggtgacatacaccctggatggcggagagctcatagtcaactacagagcacaagccagtcaggccacaccagtcaacctgaccaaccattcttacttcaacctggcaggccaggcttccccaaatataaatgaccatgaagtcaccatagaagcggatacttatttgcctgtggatgaaaccctgattcctacaggagaagttgccccagtgcaaggcactgcattcgacctgagaaagccagtggagcttggaaaacacctgcaggacttccatctcaatggttttgaccacaatttctgtctgaagggatctaaagaaaagcatttttgtgcaagggtgcatcatgctgcaagcgggcgggtactagaagtatacaccacccagcccggggtccagttttacacgggcaacttcctggatggcacattaaagggcaagaatggagctgtctatcccaagcactccggtttctgcctggagactcagaactggcctgatgcagtcaatcagccccgcttccctcctgtgctgctgaggcctggtgaggagtatgaccacaccacctggttcaagttttctgtggcttaaggaagtgtgaagatatgatccagtccagggctaggctcagccacctgtctcctgtccagaaaaaaggtgaagattaagaagctttcagaatgattctatggattaaaatcatacaaatggtggctgttctgagaatcagtctgggtattgatttccttttccagtgactggctccaggccatgtctaatgaccagctcgattccctgtgcagttcagagggcaagtgaacccaaccaacaatgtcgtcatctaagccctgaccctagccagggactcccatgctgctgttggctccatctctccacactgcctctttcttttcaactttttgcccttcctttctttaaagctattctcacattgcttttatttcctcctccttcacctccaaccactgtcagcagcactctggagttttcaaatgtcacattagcctcaccctgcatgctaggagatggacctgtctctatacagcagtagatgattgataagtgaggaaactgaggcttacagaggttgaagaccaacaagctaataaataaaaagttgaggccgggcacggtggctcacgcctgtaatcccagcactttggaaggccgaggcaggcggatcacgaggtcaggagatcgagaccatcctggctaacacggtgaaaccccgtctctacataaaaaattagctgggtgtggtagcacgcacctgtagtcccagctacttgggaggctgaagcaggagaatcgcttgaacctgggaggtggaggttgcagtgagccgagatcatgccactgcactgggcaacagagcaaaactcgatctcaaaaaaaaaaaaaaaaaaaaggaaaaaaaagcagctctctctctcgggagagggaggggacttccgagaggaaaaggcctgcaagagcctttgggttaactgagaaagcacagcccggccaacgcttgggaagaaagacaggcaagcactggaaacaggagctattagggtgaggagagagccttgcctttcacagcacagtgaggatgacattgcaccagggacagagattgtatgtgacaaggctggggctccttctttcctagacaatcaaagtatcagtgatgggttttggttggtgattttgaaaaaaaaaaaaaaaagtatgttatactagtgtatgctgtactgaattgaaataaaaccaaaatctgcatcttcagaa

SEQ ID NO: 501 - DNA, 5242 bp, Homo sapiens
aggcagagagagtcgggttacaagatggcggatctgtagtagttaccgcggcggcgggagagcaagcgagccctggggggcaaagagacgggagagtgggtgtatgcgcgggtgaagtgagaggtaacggggctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggataatatagttggatcaaacaaaaacaacacaatttgtcccggtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtgtaccatctatattgcgtagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagacagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccaaaatgattttctctagaaatttgaaagtagatcgaacagaatgttgtcaaccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccataattgatgtttgtgtttggtttgttgtaaatataaattaactccattttgagatatgtcaattttacagtatcttttaaaagccaataaaattatccataaatatttattataaactgctagatcataccccaattttaatgaaataattctaaacaaatgcgggtcaatggcactttatcagtgactacttatagaaggtaagccttggggaaatcatagcatcacagtatggagcttttctcaccttttcaattaaaggtgtacatatagtaagaaagaaagaccttccacctcataaggcaggtgactcaggatattttaaactaagatcagtaaagttcccatccactttctttgaatcatcaaattttatcgagacccatctctcagcttttagtaaatttcttcttaaaataagcccacatgtaaaacactttcctagttactttttgtttgtttgtttgagtctcgctctgttgcccaggctggagtgtagttgcacgatttcggcttattgcaacatccgccacctgggttcaagcaattctctgcctcagcctgagtagctgggattacaggtgcccgtcaccatgccaggctaatttttgtattttcagtagagacggggtttcaccatcttggccaggctggtcttaaactcctgacctcacaatccacccgcctcagcctccctatctctgtatcttatgaagacttcctttttctttctgaagagctgccataagtcttaaacatttaaatcatcagaaccttttcttgtagcagaaatgtgaatgttttcttgaagtacaggttacggttttcatggtacaagtgcttacctacgacgataagagaacaaggcttaaaatatccctcaaaagaacaattgtgagaattccatgttagcggctgtctttaaacgactaccctcaggcagatctgggtttttatatctttatcttcattcagtgaagcaagccaaaagcccacatttgtatgccttaggtcttcttaaaatggtatctgtaaacatgtgtccaatataaaaactatttttaataaaaagttacatgaaacaga

SEQ ID NO: 502 - DNA, 625 bp, Homo sapiens
caacaatccattggctaacgaggtcgatgacgccagacgcaagacgccgggcctacagcgggagcgtgaggaaagccgtgcgttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcattccagttttttctaacatgaattttcctggttgacattgatttcaaagggttttatgcattaaagtgaaagaatcttattaaatgtgaaacatggcaagga

SEQ ID NO: 503 - DNA, 748 bp, Homo sapiens
aagacggggattggccatcgcttccggaagttgtgagctttgtttcggagcgggagctcttccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtattgggacattattggatgctatcatttgtagaatgtcaacaaaagatgttttatgaaatgtcagaaatattaacaaaaattctcagcattaaagaaaacattgattttcctttcctgactataaaactaattgtgcattatagaaaagtttaaatcacagaatggtatt

SEQ ID NO: 504 - DNA, 1860 bp, Homo sapiens
ctgcagctcactttctccctgtttgctggccagcagggtttgtggccgcctctgctgtgacgccacagcctggtgaggagggggctgcagttcctcaggaaactgccagtggacaaagtcataaacaagagttccagttccctggaacctgagtcgggaggcctgcaactcactttctccctgtttgctggcccagacaggcctgtgctagagggctggatagtgtggtagtgtggtggatagagtgctgcctctatccacaacgcagccatatgctgactgaagataactttgtgtctggaagagccctctgatttcttacactaatggccttacacgacatggaggattttacatttgatggaacaaagcgcttaagtgtcaactacgtgaagggaattcttcaaccgacagacacctgtgacatctgggataagatctggaacttccaagccaagcctgatgacctgcttatttctacctatcctaaagcaggaacaacatggactcaggagatagtggaattaatacaaaatgaaggtgatgtggagaaaagtaaacgggcaccgactcatcaacgatttcctttcctcgaaatgaaaatcccatccttaggatctggtttggaacaagctcatgcaatgccctcaccacggatcctgaaaacacatcttccctttcacttgctgccaccatccttgctagagaaaaactgtaagataatctatgtagcaagaaatcccaaggacaacatggtgtcctattaccatttccaaagaatgaataaagctcttcctgctccaggaacatgggaagagtattttgagacttttctggctgggaaagtgtgctggggctcctggcatgaacatgtgaaaggatggtgggaagccaaagacaaacaccgtattctctatctcttctatgaggacatgaagaagaacccaaagcatgaaattcagaagctggcagaatttattgggaagaaattagatgacaaagttctagataaaattgtccattacacttcgtttgatgtcatgaaacagaatccaatggcaaactattcatcgattcctgctgaaatcatggaccactccatttctccattcatgagaaaaggggcagtgggagactggaagaaacacttcaccgtggctcagaatgagagatttgatgaagattacaagaagaaaatgactgataccagactaactttccacttccagttctagtaaggaagaaaaactgaaaatgttttagtttattacccagtatatttgggtaataatgaaagtttaattctcataacaaatgatatcagattccagttatcagaatagtttactgtgtttgctcttattcactctactaaaaaattattttaaaaggctggaggcaaggtggtgacaggcagcagggtggcgacatggagagagggaagctcaataaatcactaggtacaatcctggtatcattgccaattatcatcatatttacattttctacaatcatgtgcttattaacatattggaaatgcttcagtcctcacatgataatacactaacattttcagattaagttttggttcaagttaatttttttttttttttttttgagacggagtctcgctctgtcgcccaggctggagtgcagtggcacgatctcggctcactgcaagctctgcttcctgggttcacgctattcccctgcctcagcctcccgagtagctgggactatgggcgcccaccaccactcccggctaatttttttttttgtattcttagtagagacgaggtttcaccgtgttagccaggatgttctcgatctcctgaccccatgatccacccgcttcggcct

SEQ ID NO: 505 - DNA, 5279 bp, Homo sapiens
gcgggcttggctggcctggggctcggacttggggccggagccgcgggagccggcggacgctggaccaggagccccgacgtgatcgcgtggcgggtggtcgggtctccgggtggccgggtgtcggccccgggatccggcggctcgctggcgggagtcggcggcctctgctgggcctgggtcccggctcccggcccggcccgctcccactgcggccgccatgtggtgcctgcactgcaactcggagaggacccagtcccttctggagctagagcttgacagcggcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccgggaagcgagggcgtcgcagcagtgcgggatcgctagagagcaatgtggaatttcagcctttcgagccactgcagccgtcagtgctgtgctcctaagccatgggacccgaggactgccccccggcgcctgcccaggcggaggccctttcagaaagggcgaagctcacgcctgactctgcgggccgcggggccgcgttcccagtggacagcgtggtgagccgtggccggacggcaggaggagaggggagccccctctggctgtgtgtcaccttggctggctggctggccagggttttgccgatttccctcctcacatccctcccaccctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctgtctcgcaattttgaggaggctgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattgagtatgtcagcttttctcaccctcttctgtgctgggaggagagtctaactgtaacctttaggttgttccagaaaagattcaggccgtttggcacagaattgctctttctgaagggtagcagtaatgaataggaacagacagaaaaccccaggaggggctttcaggaaactctccctctccatcgccatcctgcaagctccacagcctcgggctgccagcctgtggcactgtcctcggtgtgtcctggagctgtgctgggcagcagggcctcgcgtaaggaactgctggaacccactgagcccttcccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcggggtcctgtcatcacatcccctgggaggggaggcaggaggaggccgagggccccaggatgtctgcctggtcccttctcactgtgaggacgcccttggcacacctttctcaagtcacacaaattactgcagttacatacagaattgctgacaggagcaggagacgctgagggaaacagctggcaatgtgacaaaagtcttttctgggacaacaatcaaatcatgtatttgtatttttttaagtttaccaatgaattgtacaacaatgtaaaaataaagttcatcctaatatgctgtgcacatcttgcttaaaaatgtcttcagcacccagtgcagtgatctttccctcacacactgcatgcagcaggagcctcttgtttttcttaatgagctgaaaagacagcagatgttcacagctgatgctgggtgttgactcagcgccacgggaagctctgtgcccgcaggtaagcacgcacagtcttacagttctccttgtaaaatatcatcacccttcctgcctgagaaacgagtacatttgtattttatgtaacaacaatagtcaaggcagcattgcaacactgagcagggtgaggtgggggtgctgagcacaggacaagagggaggaggcctgccctccattcagatgcatctgcatcgcccttctgtgtgcagtcacatcgagactgcacacagcatgcatctcctcttggaaaatatcttttgcctccgagttgttttaagcaattagaatcaggtcctgaatccccagactgttcagagacttcaagggacacctccctcacaagaagcctggcacccccactgtgtacctttgagaggaaaggagtgcgtttgttttcatctgcattctgtttgtcagtggcaacagactctatcaatgtaaaaccatggttgtgatcatgtggggaaatcaaataaatcctttgaaactct

SEQ ID NO: 506 - DNA, 3883 bp, Homo sapiens
aggcgttaacccagggaaggcagtggcaagatggcgtccctggatcgggtgaaggtactggtgttgggagactcaggtgttgggaaatcttcgttagtccatctcctatgccaaaatcaagtgctgggaaatccatcatggactgtgggctgctcagtggatgtcagagttcatgattacaaagaaggaaccccagaagagaagacctactacatagaattatgggatgttggaggctctgtgggcagtgccagcagcgtgaaaagcacaagagcagtattctacaactccgtaaatggtattattttcgtacacgacttaacaaataagaagtcctcccaaaacttgcgtcgttggtcattggaagctctcaacagggatttggtgccaactggagtcttggtgacaaatggggattatgatcaagaacagtttgctgataaccaaataccactgttggtaatagggactaaactggaccagattcatgaaacaaagcgccatgaagttttaactaggactgctttcctggctgaggatttcaatccagaagaaattaatttggactgcacaaatccacggtacttagctgcaggttcttccaatgctgtcaagctcagtaggttttttgataaggtcatagagaagagatactttttaagagaaggtaatcagattccaggctttcctgatcggaaaagatttggggcaggaacattaaagagccttcattatgactgaattacactcatcctttggaagagtgagcaagcagtggcagtttttcacagctcatcttgctgtgttcaattattaccatcacagccttttaacaaaatcatcttaaaatgctacccttcagccttaccctttaatggaaaaatgaaaggaagtgacaatacgggaggtccaaactttgtccctgttctctgtgttccttacctttctgtccctgtgtatagattatgtaaaagccttgtgtaaatatgagatgttgtcaaaatgatgcagtaaatgagcaatgacagtgtactgcagagaaaatttactcttgcctagaactggagggtttttatgggtctgtaattttcccacactcattgctgaaagcttaattaagtacttcaaaaacgtatctccattgttttaccttcttgaggggaacggtcttgttaaccagccctgagttgtctaccccaaacaatctctgtcattttcaaagatgcaaaatggtgttatttaattgtctccaccattgtcacacacaggaatgcctaataatagcaacccttgtctccctcttctctcctttgcaaatggctcagtgactggaagaggcggactaatagccagagttaaatataaatacaaattaataatacatagagaacagcaataccagaaaaaaagaattctggtaaaatgatgtgaaaaattgacagctccctcactcttaaggttgctgctatatacagtctaggttttctgtttggaaataggtagggtaaaatctaagacctgcacaagggcagtgagagacatttacagcctcctctctatttgtttttttaaggaaaagtcaactcctgaaatgtcccttagctataatcagaaaactaagaatattattctgtgtcaacaatgtatttatggagagaagtaaaaataagttccacagcaacacatttacatgaattatgaactaggattcttggatttcataatcactccaaagctttttggggatggtgtgtgtgtgtgtgtgtgtccgtaattgttcatcattactttttttaacctatctttttgcttgcttaatcttctctgccccagttcttcctgagtatatgaatttgatttctaaaaacaatttattcaacactctatcacccgtattctctctctggctctgctgcaggtctctgcactcctgattttgctccatacttttaaataacaataataaatatacagttttcatttctcatttaaaaaataggtggaaaacaccaaattcactttctgttccattttaattaggtttcagaagtatcttggaaatcaaggtatgctgcaagaggatattaaaataagaatgttagagagtccttttagaaaggcagtcttgggaatttggaaaaggatttttaaagcagctttcatcagctagactgttctccagcctttctttacttcctctttgaaaggacatagccctggtttctttttgacacaaaggaaagctatgcaaatcatgatctgtatgtagaattggtcacaagtatgttgttgcataggctgtacagttgggaagtagaaaccaaatgctacccagagacctaacccaattaagctctttgtatttctccttcaagaaataaatcttccttccttctttcttcctctttcttttaattttaaaaaaattcatcctgatttttttattttctatcttatttaaaaaataaaaataggccaggcgcggtggctcacacctttaatcccaacactttgggaggcgggtcgatcacttgatatcaggagtttgagaccagcctggccaacatagggaaaccctgtctctactaaaaatacaaaaattagccaggcctggtggcacgcgcctgtaatcccagctacttgggaggctgaggcaggagaatcacttgaacctgggaggtggaggttgcagtgagtcaagatcgtgtcactgcactccagcctaggtgacagagtgagactccaactaaaagaaaataaataaataaatatataaatatataaataaataataaaagtaaactattgctgatgactccagggtcaatctggaaaaattaacagtattcctcaactccattactttctgcagccaagcttgattccttgaattatagttttctaagaaaaaatagtttttaataatctaaggtaaatttgttgcaattattagcagcagcataataaggctttttgcgcaaatgaatgttattagctagagttattcaaaaaagaatgaagcacaatttttgctaggacttcttgagaactattcataaaaatgcttttagataataaacaagtataaatgtcaaaatatttttttaaaagtataattggccaggtgctggctcacgcctataatcccagcactctaggagactgaggcaggaggatcacttgagctcgggagtttgaggctgcagtgattcatgattgcaccactgccttccagcagcctgatgacagagtgggactccatctctttacatatgtatatcttactctcttgatgggacaagttggtagaaataaagattttttttttctgttgtgatttcggtgtctgaccaattttctgactcattgtgaaggtgaccagatatgaaggcatatatatgactactcctctgtcccttaggtgtataagacttagctggaatccaactaaagatttgggctggtctctccatcttaacgttgatgggattcaggacacataaccccaaaatattgcaccctgttatttgagaaaactgcagaagcaaggtttctcataccttccccttaccccttctcccctgaagcaggccataaaccctaagtgactgttccctgaagtagatcataaaaccttcattccataggtaccctttatcctcacagatacagagacaccaagaagaatctggacaaataggacttgctaagttctccacagtttattaccattagattatgtccttttgtcctctgattatacttctgcataagactgtacataaaaatacacaagttttcctatttcttttttgtcttcatttctgaagattcctgtcatgtaaaacttacagtaaataaatgtgtgtgcttttctcaataa

SEQ ID NO: 507 - DNA, 6955 bp, Homo sapiens
gagcagttcgactttccgcccaaactgggggatgctagaccgcgggcacctctgaatcttatgccttcagtgatataatcctccgtgtccttcgagtccctcctgctgcagacaggtcccctatacttcggtacacacgagcctttcgcgcccaccgcaacgcagcctcgggaggcaggacagacccctgcgagtgtagattgcagctgcatcccagctcccccctccctggcacgctcctccacctacagctgcgctgagctgccgcatctgaacgcaaagcaaacgctgcagtgacggttcctgcgtcaccttaactccaaagtaaatgctaacgtttcccgtgtctgtaccttctctcaatcggcactctcaaaacatctggcacggtgttcactaccctaataagacctcagcttccctcgggaggggagggagcactggcagttgctgggtaatttgaagacgacggtggagggtttggtatcaaccaacagccccaacgtctggtctaagtatggtggcttggagcggctttgcagggacatgcagagcatcctctatcacgggcttatccgtgaccaggcgtgccgccgccagacggattactggcagttcgtgaaagacatccggtggctcagtccccactcagcccttcacgtggagaagttcatcagcgtgcacgagaacgaccagagcagtgctgatggtgccagtgaacgtgctgttgccgagctgtggctgcagcacagcctgcagtaccactgcctctcagcccagctccggcccctgctcggggatagacagtatatcagaaaattctacacagatgctgccttcctgctaagtgacgctcatgtcacggccatgctgcagtgcctggaagcagtggaacagaacaacccccgcctcctggctcagatcgatgcgtccatgtttgccagaaagcacgagagcccgctcctggtgacaaagagccagagcctgacagccctgcccagttccacatacacccctccaaacagctatgctcagcattcctactttgggtccttctctagcctccaccaatccgtgcccaacaatggctcagagagaagatctacttcctttccactctctggccctccccggaaacctcaagaaagcagagggcacgtctcaccagcagaggatcaaaccatccaagcccccccagtttcagtctctgcactagccagggattcccctttgaccccaaatgaaatgagctccagtactctgaccagccccatagaggcatcctgggtcagcagccagaatgattccccaggtgatgccagtgaggggcctgagtacctggccattggcaacttggacccccgaggccggactgccagctgtcagagtcacagcagcaatgccgagagcagcagttccaatttgttctcctccagcagctcccagaagccagattctgctgcctcttccttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccaggaggccccaggaatatcaccattatagttgaagatcccattgcagaatcctgcaatgataaggcgaagttgagaggccctttgccctactctggtcaaagcagtgaagtcagcacacccagctctctgtacatggaatatgaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagctttcgggtcacctccagcagctcccagttcagctcacgtgattcggcacagctctctgactctggctctgctgatgaggttgatgaatttgaaatccaagatgctgacatcagaaggaacacagcctcaagcagcaaatccttcgtttcctcccagtccttctcccactgcttcctgcactccacgtctgctgaggcggtggccatggggctcctgaagcagtttgaggggatgcagcttccagccgcctcggagctggagtggcttgtcccggagcatgatgcccctcagaagctcctgcccattcctgactcactgcccatctcaccggatgacgggcagcacgctgacatctacaagctgcggattcgtgttcgtggcaacttggagtgggccccgccccggcctcagataatttttaatgttcatccagccccaacgaggaaaattgccgtggccaagcagaattaccgctgtgcaggatgtggcatccggactgaccctgattacatcaagcgactgcggtactgtgagtacctgggcaagtacttctgccagtgctgccacgagaatgcccagatggccatccccagccgggttctgcgcaagtgggacttcagcaagtactacgtcagcaacttctccaaggacctgctcattaagatctggaatgatcctctcttcaacgtgcaggacataaacagtgccctctataggaaggtcaagctgctcaatcaagtccggctgctgcgggtccagctgtgtcacatgaagaacatgttcaagacttgccgactggccaaggagcttctggattcctttgacacagtcccaggccacctgacagaggacctccacctgtactcactgaatgacctgactgcgaccaggaagggggagctggggccccggcttgctgagctcaccagggcaggggctacccatgtggagagatgcatgctctgccaagccaaaggcttcatctgtgagttctgtcagaatgaggatgacatcatctttccctttgagctccataagtgccggacctgtgaagagtgtaaagcgtgttaccataaagcctgcttcaagtctggaagctgtccgcgctgcgagcggctgcaggcccggcgggaggcactggccaggcagagcctggagtcttacctgtcagactacgaggaggagcccgcggaagcgctggccctggaagccgccgtcctggaggccacctgaagaaagcacgtgcagccctccctccgggccgggtcacacctgttgcagaactgagccactctttgaaggactcgccccacctggggcttctttttttttttttttttttaattatcatcatctttttttttttttttactgacttgtctgacgtctgtgtgcagtcagccgtcggcaggttgatgggtccagagtctgtggtgacagataatttgtaaacaccaggtgtttccatcagaactgacatgcgggtccttcagtgaagcttctagtgcctctgtcagtggaagagacagcaagaccaagttcttccagcgtctgtggccttctcctctaggtttcacctgcatgtcaggtatcatttccaattttcctttgtttcagttctggagcttctgagccaggcctttctcaaccacctctcctgctgctgaaacggggatggcgttttccctctccctgtcctggactggggtcagactgtgccccgaggagaagcagcagagaataggactacgtcatgggcatttcgtccacttatttgggtattttgggggccacagaacaatcctgactatcctagactcctcagagacctcagaggcagctgtgaatgtccctatgttgccgggagttcctgtttgaaatatttgaagcatagaggatgccacaagctgactttcttcatctaccttggtgatcttgaagcaaagaacagaactgatgctcaggccaggctcacctgtagccttacgccgcaagcatacgtgaggcgccagctctgtcgctgaaggagcgcttactcagaggagcggtcggccccctcttggtgttaaggtctcttagttaacctggctttttggtgcaggtgtgatctttgaagctcaggcaggtccctgatgccatcctaaggtgaggacaggaacctcacccaccatcttcttagcgtgtccctgatgactctgtcctctgttagatggtcgttgtgcttctgagtaaaagtacaacccgactccgttctctccccttcctgcagcagagctgggtccttccctggtggccgagtctctcttgccttagcttctttggtcaaagttggagaaaagcttcctgctattagtgctgttacagaacttgacggtttgtggatgtgagtgtgaatgtccctgtgttcttgggataacaagagcctttatgccaattatgcacttaactctgtgtagcctggtaatgtttatctgttcatttgataatgctgattttagtgtgctgcccccctccccccgttaatgtgtgttgatggtgaagtccttttgataatgctgattttggtgtgctgcctcccccttcccccccgttaatgtgtgtgttgacagtgaagtccttgggtggggccatgtgtgtgtttgtgatgttccttaagttgatgcagcttctaacctctgtgaaaacactggtcagagtggcttctccaagagctggcagctctgtgaactaaagcctgcatcatttttgttctgggattgaattctgcccatgggcatgtcttctcatagttgcttgctggtaggaaagaaatgggcgtgggtgctgccctggaagctgagcggaaagttgcctgtggttggtggaagctgatgagagcttgagctggcggtaagaaggagtctcccagggaagtgggagaggcattaaggtgatggccagggctgaggctccaccagcgtgagagggaacatgtgggaactggcccctgcccttgattcctctgcctcaaagttgggatctgaaagccatgtagggctagaagaccctgaggctgttctcccttctgttcatagtgagactcaaaaagccaagtcccagaagttctgaagggctgtgactagaagtgcccaggtccttcagggagctttaagaatgaccccacagaactcaagtttaactaggggttaggtcccagattcagacccaggagtttataaaaatgagctctacttccagttttggtttaaattacacatccaggccaggcacagtggctcacacctgtaatcccagcactttgggaggccagtgcgggcggatcatgaggtcaggagtttgagaccagcctggccaatgtggtgaaaccctgtctcttccaaaaatacaaaaattagctgggcgtggtggcacacgcctgtaatcccagctacttgggaggctgaggcaggagaatcgcttgaacctgggaggcagaggttgcagtgagccgagattgcgccaccgcactccagcctgggtgacagagtgagactccgtctcaaaaaacaaaaaggtgacacatccagctctttctccaggtcactgcgctggaggacagatgtgccgtcttgtcctgcctgtttcacatcagcataggatcaaaggatgacaatgctgacagcttctgaagccgaactcaacagtctcataggctcctcacttgtcacttatttttccctagctccctcaaccgcaccccatccctttagatcgtgcgtctgttttagtgactctgacacgatgccgtcctcaccttccaaatacccagttatttattcaagaggggggaagtgggtagaggatgggatgttttggaagcactttgcaagttaccactatctgaaaatcccctgctgttgcggggagaagctttgaatgcactgaagagaattccttctaaatgaaggcaggtgatagtgttctttctgtaagtaaagggaaagaaaaaaaacatagtttgcttaccaggtggagacaagattcaagacatagcagaagagtggaagacaaatattttccacttaaatgaggctgtttttgacgttctctgccaaggatttagagctttcgttgaactaacataaaaggagtgcgagtcttagtagagatgttccgtgtgtgccgcccgtgctctgaactgcgtttccacctgctgtggtgcttgtgcagcctggcagttcattgtcatctttaataaactaaggaaataaaattctgtctttcgtcagcctgccttgactgtcaagaaatggcatgtgtccactgtaaagcaggtatatctgaacattgagaaggtttctgtgttataatgtaaagcaaactggaccacacacatcaaggaaagtgaggtggagtggctgtgtctctaacttgccatgagacctcgagcgaaccacttcacttctctgggtttctggtgcatggtgtaactgtcacttaaaatgaggtgtcttcctctccgcaacatctgacttgccttagatgcttcagttcccacttctgtgagcagctagcatctttctcttctgctcctggcccactggagctccagctctacgctgcaactctctcaacatttccccttaaatgtccccttgtcatctccaaccagtgtgtctaaaaccagcataaattccgtatttccaaaaacctaaccattagtcacccaggtttgaaaattaattgtcttcaacttcctctgtaagtggcacactgagctcatcacgcatcgtctcattcctactccctgtcatcaagttctgtggatgttttcctctaaaataaatctctcattacttttctgccactagcacacaaa

SEQ ID NO: 508 - DNA, 636 bp, Homo sapiens
ggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacgcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaa

SEQ ID NO: 509 - DNA, 2025 bp, Homo sapiens
aagggccgccccttttcctgcccacgtggtctcgggctcctgccccgtcctgctcacgagttcagggctcctgggcggccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaaggtaccacaaccccgattgctttcgtgaaggacattttatttccttacatcgaagaaaatgttaaagagtatctgcagacacattgggaagaagaggagtgccagcaggatgtcagtcttttgaggaaacaggctgaagaggacgcccacctggatggggctgttcctatccctgcagcatctgggaatggagtggatgatctgcaacagatgatccaggccgtggtagataatgtgtgctggcagatgtccctggatcgaaagaccactgcactcaaacagctgcagggccacatgtggagggcggcattcacagctgggcgcatgaaagcagagttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgagaggccagtgctgctgaggaagcagatgtgcacgtagctgtggtggtgagaccaggcaacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttcactca

SEQ ID NO: 510 - DNA, 1517 bp, Homo sapiens
agagataccactgagtccagaagcaagacctgtgagagtgcacagtgccacttcgccccatggctgaagatggtttgcccaaaatttattctcatcctccaacagaaagcagtaaaacaccaactgcagcaaccattttctttggggctgacaatgctattcccaaatcagaaacaactattacttcagaaggagaccacgtcacttcagtaaatgaatatatgctagaaagcgatttttcaacaactacagacaacaaactgacagctaaaaaggaaaaactcaaatcagaagatgatatggggaccgactttattaagtcaacaactcacctacagaaagaaattacctctctgactggcactacaaactccataacaagagactctattaccgaacatttcatgccagtgaaaattgggaatatttcatcaccagttactactgtttctttaatagatttttccactgacatagcaaaagaagatatcctcttagctaccattgacacaggagatgcagagatctcaataacctctgaagtctctggcacactaaaggacagcagtgctggtgttgctgacgctcctgcctttccacgtaaaaaggatgaagctgatatgagcaattataattcctccatcaaatccaatgtccctgctgatgaggctgtccaggtcactgattccactattcctgaggctgaaatccctcctgctcctgaagaaagcttcactactattccagacataactgcccttgaagaagagaaaataaccgaaattgacctaagtgttttagaagatgacaccagtgctgtggctacattaactgactctgatgagaagtttatcactgtgtttgaactcactacctctgctgaaaaagacaaagataaacgggaagatactctgctaactgatgaagaaactaccgagggagccagtatttggatggagagagatactgcaaatgaagcagagacccattctgttttgcttactgctgttgaatccagatatgacttcgttgtccctgcatcaatagctacaaacctagtggaagaatcatctacagaagaagatttgtctgaaactgataatacagagactgtacctaagatcactgagccattttctggaactacctctgtattagataccccagactataaggaagacacctccacaactgaaacggatatctttgaactactgaaagaagaacccgatgagttcatgatttaaaagcaacaaaagggataccatgtagaattgtgcaatagtctagccagctagccttaacatctaagaaatttttccaacaagcaaaaacctttagaaatgaaagaatgtgggcatttaaggtcttaaacactgaatatcacactcttcttatgactcttgttagcgattcaaggacataaatcttcattcttttctggcacagactacttaaatgggtctgttttcactttgctcatttttcttcaataaatctttttggcaagcaactga

SEQ ID NO: 511 - DNA, 1104 bp, Homo sapiens
agcacttgaagttcaggcagcgagagttgacatggggccagggctgcgcccctggggcgggttgaagacagggtgagtctcttgatattcaggaaatcatcgcgcacccagtcaccagcgttcgggagcctgtcgcagcgggaccgacggaatccggagcaggcgacagggcgcagaagcgggatgtacttctgttggggcgccgactccagggagctgcagcgccggaggacggcgggcagccccggggctgagctactgcaggcggccagcggggagcgccactctctgctgctgctgaccaaccacagggtcctctcgtgcggagacaacagcaggggtcagctgggccgcaggggcgcgcagcgcggggagctgccagaaccaattcaggcattggaaaccctaattgttgatctcgtgagctgcgggaaggagcactccctggctgtgtgccacaaaggaagggtcttcgcatggggagctggttctgaagggcagctggggattggagaattcaaggaaataagtttcacacctaagaaaataatgactctgaatgatataaaaataatacaagtttcctgtggacactaccactccctggcattatcaaaagatagccaagtgttttcgtggggaaagaacagccatgggcagctgggcttggggaaggagttcccctcccaagccagcccgcagagggtgaggtccctggaggggatcccactggctcaggtggctgccggaggggctcacagctttgccctgtctctctgtgggacttcgtttggctggggaagtaacagtgccgggcagctggccctcagtgggcgtaatgtcccagtgcaaagcaacaagcctctctcagtcggtgcactgaagaatctaggtgtggtttatatcagctgtggtgatgcacacactgcggtgcttacccaggacgggaaagtgttcacatttggagacaatcgctctggacagctgggatacagccccactcctgagaagagaggtccacaacttgtggaaagaattgatggcctagtttcgcagatagattgtggaagaaactctaagcatggatttatgactttcttttag

SEQ ID NO: 512 - DNA, 2902 bp, Homo sapiens
agggtgctcggctcgcggggactggcctccttcggcagctggaggcggtcactcacgctgggctaggagctgaggcgagaagggccatgcggacggcgagggagtccagagccttgagcccggtgctcctccctcgcgcagcggtggctctgcggccgctggagtaaacactgcctttgttccctagcgcctcgtctttcgtcgccccgtgccctcacgccgccgggctctggccggcccgccctcggtccttgaaccccatttcggctcgtgccgtgcggatgcagctgccgggcctgggtttgggcattgagcgggaggaggaggaggagcggcggcgcctgggcggcatgcgatggggaactgctgctggacgcagtgcttcggactgcttcgcaaggaagcggggcggctgcagcgagtaggcggcggcggaggatccaagtattttagaacatgctcaagaggtgagcacttaacaatagagtttgagaatctagtagaaagtgatgaaggggagagcccaggaagcagtcataggcctcttactgaggaagaaattgttgacctaagagaaaggcattatgattccattgccgaaaaacaaaaagatcttgataagaaaattcaaaaagagttagccttacaagaagagaagttaagactagaagaagaagctttatacgctgcacagcgtgaagcagccagggcagcaaagcagcgaaagctcttggagcaagaaaggcagagaattgtgcagcaatatcatccttccaacaatggagaatatcaaagttcaggaccagaagatgacttcgaatcttgtttgagaaatatgaagtcacagtatgaagtttttcgaagtagtagactctcatcagatgctacagttttgacaccaaatacagaaagcagttgtgatttaatgaccaaaactaaatcaactagtggaaatgacgacagcacatccttagatctagagtgggaagatgaagaaggaatgaatagaatgcttccaatgagagaacgttccaaaacagaggaagacattctacgggcagcacttaagtatagcaacaagaagactggaagtaatcctacatcagcctctgatgattccaatgggctggagtgggaaaatgattttgttagtgccgaaatggatgataatggaaattccgagtattctggatttgtaaatcctgtattagaactgtctgattctggcataaggcattctgacacagatcaacagactcgatagggtaaaattgtgtgaccttgtttatcagttatgaccaaatgttaaaaaccaactagaatgtataagtgattgtgcttagcctttttgtaagggagatgtgtaagaaaccatgttgtaaatgcttattttattacaaaggagtagggatgataggatctgaattgatacagaattaagtgcaatttcatcatctgccttctgcttttcaagaccaatttaatggtcctgtcatgttactgattaaatttactttgtcttgtctttatagcatttctgtttactatggtagatttccactttcaatttttaaaattaattttactttgaatgatttatgaagcctatttcattgtctaactatgaaaatattaagacttttttgttaattctcagccgatgtgaaggaagcatgaggagggatcgtcagattcagatttagaatagtgttcccgtttccagcattatttatttctatgacttctttggattttattatctaatagtaagtacagttgatgtgggtagatgactctaagaaatgctgaagtatcggcattacatgtgtttatttacatgtcctagtatgataatgttgattcaatctgaacaaaagataatataaaaataacccttcagagtttggacatttcaagttggtaataataaaaaataatatttaagaagatatatatatatatatatttagttttttccacttcattttacatgccactatattgactttaattgatatacagtattaagtttttaggtgccattatttttaaaaaattctatatttccaatgaacgatgttagattttacacagaacatattctctgcatgatttcagaaaagaaaatctaaaaaggtaatacgggtatttcaaataaaatcctttctggtatgaaaggctccattgattttattaagccttcctttaccttgtagtacaaggtgctttaatgggatagaactaagcatatcaatatctataactgcattttgtgctagacaattactgttcttttctctaaaatgtatatgtcaatttacaaggccagggatagaaaacactccataattgctttccttgattttgctgaggatttggtatgattttagtaagcaaactgttttttggtttttccttaatgtttttaattttttttcctcttgcaacaatgacggtgcatgttcttataaatataggaaggtccagatataaatagtaacctaaagttcttgctgtgcttaaaaaaaaaaatcatgtggccctttcaatatttgaactgctaagcaatgacatctgtagttttatctccttttttatgtcatagaaattaatatgatactttaaatatgtaaatataatacattaggtaatgctattatttatatctgtcttaacataatttaagttgtagctgtgtcttggaaatatttttaaggtaatctatattcacattgcctgtgttaatgctttttaaagtttgtatacatcagatgtatatttttggtttggcataagctacgattgtaatttttcttggctttttgttcataaagaattttttgaaggaatggtaacaaatggtaatttacaaatggttgtgaataaacacatttttacactt

SEQ ID NO: 513 - DNA, 1829 bp, Homo sapiens
tttctgtggcgcttcccctgcgaggatggctaccctggttgtaaacaagctcggagcgggagtagacagtggccggcagggcagccgggggacagctgtagtgaaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtgattcaggtgtctggggattgaaaaaaaattttgctttattggagcttttggaacgactgcagaatgggcctattggtcagtatggagctgcagaagaatccattgggatatctggagagagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaagaaggttgtcaaactagcccactcatgtgctgtgtctgcaaagaatatggaaaacaccagggtcacaagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaacatgtaccagggactgcagagaatgcccggtcatgtattcgagcttatttttatgatctacatgaaactctgtgtcgtcaagaagaaatggctctaagtgttgttgatgctcatgttcgtgaaaaattgatttggctcaggcagcaacaagaagatatgactattttgttgtcagaggtttctgcagcctgcctccactgtgaaaagactttgcagcaggatgattgtagagttgtcttggcaaaacaggaaattacaaggttactggaaacattgcagaaacagcagcagcagtttacagaagttgcagatcacattcagttggatgccagcatccctgtcacttttacaaaggataatcgagttcacattggaccaaaaatggaaattcgggtcgttacgttaggattggatggtgctggaaaaactactatcttgtttaagttaaaacaggatgaattcatgcagcccattccaacaattggttttaacgtggaaactgtagaatataaaaatctaaaattcactatttgggatgtaggtggaaaacacaaattaagaccattgtggaaacattattacctcaatactcaagctgttgtgtttgttgtagatagcagtcatagagacagaattagtgaagcacacagcgaacttgcaaagttgttaacggaaaaagaactccgagatgctctgctcctgatttttgctaacaaacaggatgttgctggagcactgtcagtagaagaaatcactgaactactcagtctccataaattatgctgtggccgtagctgtttttcagataatatgtgaccaatatactgggaaagaggtagtcacagagaaagggtaaaaggtcatgctgttacaggtgtagtttgtgtgcataaataatacttccgaattaaattatttaatatttgactgatttcaataactgtgaaaaataaaaaaggtgttgtattgcttgtgagaa

SEQ ID NO: 514 - DNA, 1469 bp, Homo sapiens
gcggccgccattggctgggttcggcgcagctaacagacggcggcagtgcgagaaagccgaagatggcggtccccgcggcgctgatcctacgggagagccccagcatgaagaaagcagtgtcactgataaatgcaatagatacaggaagatttccacggttgctcactcggattcttcaaaaacttcacctgaaggctgagagcagtttcagtgaagaagaggaagaaaaacttcaagcggcattttctctagagaaacaagatcttcacctagttcttgaaacaatatcatttattttagaacaggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctgtaagctagagaccgttggatggcagcttaaccttcagatggctcactctgctcaagcaaaactaaaatctcctcaagctgtgttacaactcggagtgaacaatgaagattcaaagagcctggagaaagttcttgtggaattcagtcacaaggagttgtttgatttctataacaagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtcttagga

SEQ ID NO: 515 - DNA, 2368 bp, Homo sapiens
acatgcgcagtagctgtaggagggggtgggcgctccattgggcgtttctcttggtttttcctttccgcgcggcttgggcggacgtctcgtgagacgtgggacttctcgcgggaactgcattcaaatatcccaggcgcttactcgagagctagctgagcgaatgggccggcgactgtggagttagcgtcctcaatgtggacgccctgagctcccattaggagccgctggctgcggcagcaggggactagcgtgagagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatcagaaggaactcctctcttgtaaatcagaggaactgcgcgtaatgtctgaacgtgtgcaggaaagcatgtcttcagagatgctggctcttcaaattgagctgacagaaatggagagtatgaaggtcaagtatcagtcactaaagaagcaaaatgtatttaacagagaacagatgcagagaatgaagttacaaattgccacgttgctacagatgaaagggtctcaaactgaatttgagcagcaggaacggttgcttgccatgttggagcagaagaatggtgaaataaaacatcttttaggtgaaattagaaatctggagaaatttaagaatttatatgacagtatggaatctaagccttcagtcgactctggtactctggaagataacacctattatacagatttacttcagatgaagctggataacttaaacaaagaaattgaaagcactaaaggtgaattgtccatacagcgaatgaaagcattatttgagagccagcgggctctagatattgagcgaaaactttttgcaaatgaaagatgcctccagctttcagaaagtgaaaatatgaaactgagagctaaactagatgaattgaaactaaaatatgaacctgaagagacagttgaagtgcctgtactgaaaaagaggcgtgaggtgctccctgtggatataaccaccgctaaagatgcatgtgtcaacaacagtgctctcgggggagaagtttatcgattaccgcctcagaaagaggagacacagtcctgccctaacagtttagaagataacaacttgcaattagaaaaatcagtttctatatacacaccagtagtcagtctctctcctcacaaaaatctgcccgtggatatgcagctgaagaaggaaaagaaatgtgtgaaactcataggagttcccgctgacgctgaggccttaagtgaaagaagtggaaacacccctaactctcccaggttagctgctgaatcaaagcttcaaacagaagttaaagaaggaaaagaaacttcaagcaaattggaaaaagaaacttgtaagaaattacaccctattctatatgtgtcttctaaatctactccagagacccagtgccctcaacagtaaagacttgtctttaataagagtacggtgccacttgcctcaaaagttactatggtgcttaagattgtcttgatctgacatatatcaccttctgggttatttactcattgtgccaggacctggcattttcatgtgcctttgaccaagtgttcagaatttgcttgactctaacctggagagcttcttaagtgatgccccttcatggagcttctatgacagtgaataaactattaattgaaggaaaatgttataattaatgtatctatttgctgcattgtatatggattaaatgataaaaaacaagtaatctaccctcagagccatgtatttgagaatgcttcaatcatattttcctatgtacttttttttataaacttagttttagactatgttgtaaaaatgggaaggttgtaaactatgttgtaaaaataggaaatgtggcttaaaatatatacattatattgtttcaggattttgtcagtgtttaaagaaccaatgttcatctttgtatttatatacatgatttaaattttgtctaaaattttaaataaaactgcagtgatttatcctt

SEQ ID NO: 516 - DNA, 4599 bp, Homo sapiens
actttgccagagcggccgggtccccattcccattccttcaaatcccctttttcccggcagccgacctgtagacccaagggagacaggttgaagctagaaagagtcggggcagcagctctggtaggggagggagcatccaaaacctctggcttctgagcgcctctcctgccgcccatccacaaagccccccacagcctggcggctgccctcgaccccgcaaaacaaaggacttcagaggctggacctacagacccagatgagaaggcaaaagcgtagggaggagcggcaggagatgggaagggcgggccccgctcggagcagctgccgcttcctcccaaagtcccacgaggggcctgagtcacgggccaccgccctgggtcggcgagctgggggaagggatctggacacctggcgtgtccgggcgggaagctggtgagggcccctggggacagagcggaggaccagtggttggggcgagaagagggcagtcccgcagcgagtcccacgcggggtgggagggatctaggccccgccctctcctcggctccgccctgcgcccccttccctctcctcattgtccttagacaaagcggtcgccgcccccgcccggccccctggtctctgtctccgtccctcctcctttgctgcctctttccctcctcctctccctccctcctcccctccctccagtctccggatctccctcggtccctctctcctcctcttcctctctctggacgcccggctcctccgcaccccctcccccgggggtcccgcggcctgtgagttgactgaggggctcagacttggggagtgggtgtctcctcgcccctgtccttgctcccgtccctggcccggaccttggctgtctcctctttgtgccgagattgtcagtctgtgcggctacagcggggtggagacggccggctctgtcacggcttcatgagagcggggacggggcgcaggacttgcaggcgccggggagaagagacatggagccggcccttggcactctggggtcgcgtggggcagtcggtgggggaggcaggcggtggtgacaggacagggtgggggtggacgccagggttctgggaacgcgctggcagccctgacgcccgggttccgaaagtctcgggggtggctatttcccccgacccgcctcgggggcggagtgcggggcagaggggtgggggctggggagaggcgtggcccgagcggtgctggaagcggagccgggacctttggggcccgcgctgagacgcgcccggctgctgccgccgccctcctttcccctcttccctggtttcccttctcctctagacctgttcgctctccgcccctccttgcctccccaacaccccctcaggtcccgttgcctcctggtcctttcagggattcctggtccttccttcccacactagcctccctggggtatcgctgaggcagcctggcctgcacccaggttcccctcacccctgccacatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccaccacccccaacttgggctcacaacttctcttcactttttccatttccccagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaa

SEQ ID NO: 517 - DNA, 800 bp, Homo sapiens
gagctatgagctggacctgtccgcgttgccagcaacctgttttcttcgctgagaaggtgagctccctgggcaagaactggcaccgcttctgcctgaaatgtgagcgctgccacagcatcctgtcccctggcgggcatgcagagcacaatgggaggccatactgccacaagccatgctatggggctctctttggacccaggggggtgaacattggtggtgtaggctcctacttgtacaatccccccactcccagccctggctgcaccactcctctcagccccagcagcttcagccctcccaggccaaggactggcctcccccaaggcaagaaaagccctccccatatgaagacattcactggggagacctcgctgtgccctggctgtggggagcccgtctattttgctgagaaggtgatgtcattaggcagaaattggcaccgaccgtgtctgaggtgccagcgttgccacaagaccctgactgctgggagtcatgctgagcatgatggagtcccctactgccacgtcccctgctacggctacctgtttggccccaaaggtgggcagccccatcccagacactgggatggcatgtacatgcctgaagtatggcatgtacatggtctgtgggtatgtgtggacaacttcccctgtggttaagcataccctggcccccccaccaagttccctctaggcctgaaccctgcaccacagacccagggcctttggtgatagggctctctctctcaggtgtgaacattggcgatgtgggctgctacatctatgacccagtgaagataa

SEQ ID NO: 518 - DNA, 2540 bp, Homo sapiens
atgaatcaacgaaggagtgagtcaaggcccgggaaccacagactccaagcctacgcagagcccgggaagggggattccggaggggcggggcctctttccggaagcgcccgccgggggcggggagggggcggggccatccgcgtgaggcgaccctgttggtccggaggggcggggcgaggaggaggacccgcttgggcggttcggctgcccacagtaaccgctgggtggacctggccagcgctccgaaccttgtcctcgctgcgcgccggcccctcggagccccacagcccgggaaggaggccgccgcgggccgggcgcccgctctgccaagcggacccgcaacccggaaaggcggcgcggcggagcctggagccggatcctgctcagaccgggccccggccggccagagccgcgggcatgtcggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccggccccacgcctgccactcccccacgtgggggcgctgagccctcagcagctggaagcactcacttacatctccgaggacggagacacgctggtccacctggcagtgattcatgaggccccagcggtgctgctctgttgcctggctttgctgccccaggaggtcctggacattcaaaataacctttaccagacagcactccatctggctgtacatctggaccaaccgggcgcagttcgggcactggtgctgaagggggccagccgggcactacaggaccggcatggtgacacagcccttcatgtggcctgccagcgccagcacttggcctgtgcccgctgcctgctggaagggcggccagagccaggcagaggaacatctcactctctggacctccagctgcaaaactggcaaggtctggcttgtctccacattgccacccttcagaagaaccaaccactcatggaattgctgcttcggaatggagctgacattgatgtgcaggagggcaccagtggtaagacagcgctgcacctggctgtggaaacccaagagcggggcctggtacagttcctgctccaggctggtgcccaggtagatgcccgcatgctgaacgggtgcacacccctgcacctggcagctggccggggtctcatgggcatctcatccactctgtgcaaggcgggtgctgactccctgctgcggaatgtggaggatgagacgccccaggacctgactgaggaatcccttgtccttttgccctttgatgacctgaagatctcagggaaactgctgctgtgtaccgactgaagccaggcagggtctgggatcctcagggctccacctctccatctggaagccggagccataactgctgcagtttgggcccaggctatgtgctcttctggtgccctagggactgctgtggccagagcctggggccagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtcccatcttattgctgttgaggaccctgaaacaccgttgtttaaagacttcacacagaaggctctgaactgagccactggggaagggaagtttcagtaacatgacactaaaatggcagagacgttaaaaaaagtttttcccttctagagctgttttgcgcgcatgcatgtctgtgtgcattggggctttttagacaggcctgccctgtgactttgtggtagaggcagagagaaggaaattgtcccctgagcacggtagggccttgctgggtggggtcagaggccagtagttccaggcctttctctgtgtccagcacagacccttgtccttgctgtggaaatgatgagggatggagggacaagaggaagaatgagaggacacacgccctggagccctcaccactgccctgggggttgccatctggaggagcctggggataagggtaacccagggaggctgggcacgagggagctgactccacgtttttccccccgttcctcaccttcgagggccctgctaggtcacccctatgctggcatgaagagcatggggcaataaaccagcacagtctctgaccacttggagcgtctcatccagtgagagagacagccgttaaaagcataaacatccaaataaa

SEQ ID NO: 519 - DNA, 2491 bp, Homo sapiens
acaatgtccctttgggtgaggaggttgaaagagtttttggtttgttctgggaacttaaggtatattaagcagtccccacagacatgctgcctgcactccacctgctgagctggctctgaggctcaggagacgtggccctctgtggtcccattgtctccacgtctgtggtaacccggtgcctttctagagcaggcaggctcccggcatgggtggaaacagagcagggggccagcttcccccaatcaccggtgctgctgtggaggaagagcttggtggcgctaggacgtccttgtgaatgtgacttggaagagcagtttgggatttttttcattgcctggggatgagagggagagacaacgtgtgtcttacacatctcccaacagccgacttagatgtgatccgttctcccagagggagcaggtttctttgaacttttcctttttatgtacagcatagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgccgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaaaaaaaaaaaaactgttcatt

SEQ ID NO: 520 - DNA, 2719 bp, Homo sapiens
caaggccgaggcgcgaagggtgggaccgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagttgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 521 - DNA, 1071 bp, Homo sapiens
caggctgagcgttggaagccattttggctgcaacctacctgaagcgatgtctgcctttggtcacgacgaggcctggatggaggccggaggctttggtctggaggctgccgaaagaacggaataccagtctctgtgcaaatctaaactcttattcctgggagagcagagcgggaagacatccatcatcagccgcttcatgtacaacagcttcggctgcgcctgccaggcaactgttggaattgacttcttgtctaagaccatgtacttggaggaccaaatagttcagctgcagctatgggacacagctggccaggagcgctttcacagcctaattcctagctacattcgtgattcaactattgcagtggttgtctatgacattacaaacatcaattcttttaaggagacagataagtgggtagaacacgtgcgagcagaaagaggtgacgatgttgtcatcatgttgttgggtaacaagattgatttggataacaaaagacaagtcactgcagaacagggtgaagaaaaatccagaaacctcaatgtgatgtttattgagaccagtgccaaaaccggttacaacgtgaaaaagctgttccggcgtgtggcttctgcccttctttccacaaggacttcacctccaccaaaagaggggacggttgaaatcgaactggaatccttcgaggagtcaggcaacagaagctattgttgacagcttaggctttctctgcctcatttgatggatttcttacatttgggcttgccataccagttctcctccccacctcgttttatgatacatggccacttactctcttccaattcctaggcttggggtaaaaacagaacccctgaaagtgctatcattttttcctgaccgcatctcacagctactgggtggaagcttcttgcagcacctgggaattctaccttaccttctccgacagctaaaagacatctgtagagaatacagttctacagcagctgacatacttcaaaggccaatacaattcattctccactgtttgttgttgtttacctacaccctcaataaatggttctttaacctaa

SEQ ID NO: 522 - DNA, 6625 bp, Homo sapiens
gcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggaaaaggccaaagttgttgagcccctggactatgagaatgttattgcccaaagaaaaacccagatttacagcgaccccctccgagatctgcttatgttcccaatggaagatatatctatctcggtgataggtcgtcaacgcagaacggtgcagtctactgtaccagaagatgctgaaaagagggcccagagtttatttgttaaagagtgtattaaaacctatagcacagattggcacgtggtaaactacaagtatgaggacttctctggggactttcgaatgttgccatgtaaatctttgagaccagaaaagattcctaatcatgtatttgagatagatgaagactgtgagaaagatgaggactcatcttctttatgttctcagaagggtggtgtgataaaacaaggctggttgcataaagcaaatgtaaatagtaccatcacagtaaccatgaaggtattcaagagacgatatttttacttgacccaacttcctgacggttcatatattctcaattcctataaagatgagaaaaattcaaaagaatcgaaaggttgcatctacttggacgcctgcattgatgttgttcagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaagatgatgaaactagcagccaaggaaaagccgagaacatcatggcaagtttggaaaggagcatgcatccggaactgatgaagtatggaagagaaactgaacaactaaacaaactcagtagaggagatggaagacagaatctcttttcttttgattcagaagttcagaggttggacttttcaggaattgaacctgatataaagccatttgaagaaaaatgcaataaacgtttcctggtgaattgccatgatttaactttcaatatcttgggccaaattggagacaatgcaaaaggaccacccacaaatgttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacagggaattttctcagtgacgaatccacatcctgaaatttttctagttgccagaattgaaaaggtactacagggaaacattacacactgtgcagaaccctatatcaaaaattctgatccagtaaagacggcccagaaggtgcacaggacagctaaacaagtgtgtagccgccttggacaatacagaatgcccttcgcttgggctgccagacccattttcaaagatactcaaggctctcttgatctggatgggagattttctcctctgtataaacaagacagtagcaagctttcaagtgaagacattctcaagttgctctcagaatataagaagccagaaaagaccaaactgcagattattcctgggcagctaaacatcacagtagaatgtgttcctgtggatttatcaaattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggcaaggaacattgcagtctgtgtggaattccgggattcagatgaaagtgacgctagtgccctaaagtgtatttatggaaaacctgcagggtctgtttttaccacaaatgcttatgctgttgtctcgcatcacaaccaaaatccagagttctatgatgagattaaaattgagcttcccattcacctacatcaaaaacatcatttgcttttcactttttatcatgtaagttgtgaaattaacacaaagggaacaaccaaaaagcaagacacagttgaaactccagttgggtttgcctgggtacctttgctgaaagatggtagaatcatcacatttgagcagcagctgccagtttccgccaatcttcccccaggctacttgaatctgaatgatgcagaatcaagaaggcaatgtaacgtggatattaaatgggtagatggtgcaaagcctttgttgaagattaaaagccacttagaatctaccatttacactcaagatctgcatgtgcacaaattcttccatcattgccagctgattcagtcaggctcgaaagaagttccaggggagctcattaaatatttaaagtgtttgcatgccatggagatccaagtcatgatacagtttctacctgtaattcttatgcaactcttccgagttctcacaaatatgacccatgaagatgacgttcctatcaactgcaccatggttctcttacatattgtatcaaagtgccatgaagaaggcttggatagttatctaagatcattcataaagtatagcttccgacctgaaaaaccgagtgctcctcaggcccagctgatacatgaaaccctggctactacgatgatagcaatattgaaacagtctgcagattttttatcaataaacaaattgctaaagtactcatggtttttctttgaaataattgcaaagtcaatggccacatacttgttggaagagaataagattaagcttccccgaggccagagatttcccgagacatatcatcatgtcttacattcactgcttcttgcaataattccccatgtgactattcggtatgcggagattcccgatgagtccagaaatgtgaactatagtttggctagcttcctgaagcgctgtttgacactaatggatagaggatttattttcaatttaataaatgactatatatctggattcagccccaaagatcctaaggttctggctgaatacaagtttgaatttctgcaaacaatttgcaatcacgaacattacattcctctgaacttgccaatggcatttgcaaaacctaaactgcagcgggttcaagattcaaatcttgaatacagtttatcagatgagtattgcaagcatcacttcttggttggtctacttctgagggaaacttccattgctcttcaggacaattatgagatcagatatacagctatctctgttataaagaatcttttgataaaacatgcatttgacacaagataccagcacaagaaccaacaagccaaaatagcacaattgtacctcccctttgttggactacttttggaaaatatacagcgattagcaggtcgagataccttgtattcttgtgcagccatgcctaattctgcatccagagatgagtttccatgtggctttacttcacctgccaatagagggagtctgagcactgacaaagacaccgcttatgggtcttttcaaaatggacatggaattaagagagaagattcaagaggttccctcatcccagaaggagcaacaggatttccagatcagggcaacactggtgaaaatacccgacagagttctacaaggagtagtgtatcccagtataaccgcctggatcagtatgaaatcagaagcctcctgatgtgctacctgtatatagtaaaaatgatttcagaagatactctcttaacttactggaataaagtatcacctcaggagctcataaacattcttatacttttagaagtatgcttgtttcactttagatatatggggaaaagaaacatagcaagggtgcatgatgcctggctgtcaaaacacttcggaatagaccgaaaatcgcaaaccatgcctgctcttcgaaacagatcaggagtaatgcaggcccggcttcagcatcttagtagcctagaaagttcatttacacttaatcacagttctacaacaactgaagcagacattttccaccaggcacttcttgaaggcaatacagctactgaagtttccctaacagtactagacaccatatcatttttcactcagtgcttcaagacccaacttttaaataatgatggccataacccattaatgaaaaaagtgtttgatatacatcttgcttttcttaaaaatggacaatctgaagtgtcgctgaaacatgtatttgcctcactgagagctttcatcagtaagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacagataataattgctgtaagccaactgatagctgatgtagcactaagcggaggatcaagatttcaggagtctttattcattatcaataattttgcaaatagtgacagacctatgaaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggctgcgatgtgttatgtccatgtagcagctctagttgcagagtttcttcatcgaaaaaaattatttcctaacggatgttcagcgttcaagaaaattactcccaatatagatgaagaaggagcaatgaaagaagatgctgggatgatggatgtccattatagtgaagaggtcttgctggagttgctagaacaatgtgtggatggcttatggaaggcagaacgttatgaaataatttctgagatttccaagttgatcgttccaatttatgagaaacgtcgtgagtttgagaaacttactcaagtttatagaactcttcatggagcttacacaaaaattctggaagttatgcatacaaaaaagagacttttaggcactttcttcagagttgccttttatggccaatctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaacttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtcaatgctggtccattagcatatgcaagagctttcttaaatgacagccaagctagcaagtatccacctaagaaagtgagtgagttgaaagacatgtttaggaaatttatacaagcatgcagcattgcacttgaactaaatgagcggctaattaaagaagatcaagttgagtaccatgaagggctaaagtcaaatttcagagacatggtaaaagaattatctgacattatccatgagcagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgtaa

SEQ ID NO: 523 - DNA, 3083 bp, Homo sapiens
atgctcgaggtgtccggtgaccgaaacactcttagctgggtgcagggtgcggctcagggcgtggtcaccgggggctacttagggccgccggtgcgggggacgacgcaaaggttaactgcgagctgccgggcactcagcgcgggtcatggcgtggatactggactgccttttcgcctcggcctttgagccccgcccccgccgtgcaaaaacaaccagaggctgctctgcttgagggtgaagccgcctcccagttttccctccccctctacccccacccccatagttctctccaccaggtccagtgacaattggatgatgcagccttgataatcatccgattccagaatgggtggctgcattccttttctgaaggcagcaagggcactgtgccccagaatcatgccccctttgctgttgttgtccgccttcatttttttagtgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagagctctgcctattgaccgtccgaacaccttggataagtggtttctgattttgagaggacagcagagggctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgaggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggcttaagcgcagtggggatttttacccttgaatactccgtgcagcgagtgcgtcagctccgtgaagaatttgatcaaggtctggatgtagtgctggatgacaatcagaatgtgcatgatgtggctgcactcctcaaggagtttttccgtgacatgaaggattctctgctgccagatgatctgtacatgtcattcctcctgacagcaactttaaagccccaggatcagctttctgccctgcagttgctggtctacctgatgccaccctgccacagtgataccctggagcgtctgctgaaggccctgcataaaatcactgagaactgcgaggactcaattggcattgatggacagttggtcccaggcaaccgtatgacttccactaacttggccttggtgtttggatctgctctcctgaaaaaaggaaagtttggcaagagagagtccaggaaaacaaagctggggattgatcactatgttgcttctgtcaatgtggtccgtgccatgattgataactgggatgtcctcttccaggtgcctccccatattcagaggcaggttgctaagcgcgtgtggaagtccagcccggaagcacttgattttatcagacgcaggaacttgaggaagatccagagtgcacgcataaagatggaagaggatgcactactttctgatccagtggaaacctctgctgaagcccgggctgctgtccttgctcaaagcaagccttctgatgaaggttcctctgaggagccagctgtgccttccggcactgcccgttcccatgacgatgaggaaggagcgggtaaccctcccattccggagcaagaccgcccattgctccgtgtgccccgggagaaggaggccaaaactggcgtcagctacttctttccttagatgtttttccttctataaggtgccagacaggggaaaagggtgggggtacatctgggatgtcacaggaaacattaaggagagagttgaaggtaaagatctgaaggtaagaaggagttccacctgatgctcgggtcaggatgagaattccaaacacactgccagccccttcactggggatgcttggtctcttctgctggtaaaagcagagatgtttctgtgtcatgcccaagctccccggtgctaccttgcctttctcttttacccctgatcttggctttctctctctctctgcagactttcctttaattgatgtgacatttgtggtaaacacctttcccagggaacctcacaaatcttgagatgctttcccttccccagatgggattgcatgatttccctgactttcctaccctcctccagagagctcagttggaaaggccctcaagaggcatgctagaacgttaggtcagcctactgacagctgacaaacaattaatgcgaaatcatgtcacaccaacccatagccgtgtccacgcagcaactccaccaccttaggatttccccctccaaattattcagaccaatggcttgccaaatggcctctcccaaaattctgtacagttttgctcaggtcacgccaacagggaaacctcaagtgtaggtctaattagtgtttctgggatccaaagttagaggaaaatttagattttattgcctggatctgctttaaagacaattggtgtttacaccctcttgtcagcaaaacagctagttaggtaaggacatatagttccaagtaggtaaagtcacttgattacaaatgttcttaactatcgtctctgtaattcctttatacaggacagtacaaaattgtgggacatgctctggtaacacacagatatgggttgcatatgatccagaattacagctgatattatggatgacaactgctaaggtccataaaatgaagactgtattgtattgagggatagaaattgatcatttaatgggtaacaactgctgagctcaaagatttgtgattgttaaaacttctctggcatttaatcattaataaacatctgtattgtgacagc

SEQ ID NO: 524 - DNA, 10075 bp, Homo sapiens
tgtagcagccttagtcgccgccgccgcggggcgaggtcgccgccatggcccgctggatcccgaccaagaggcagaagtacggggttgcgatctataactacaatgcttctcaagatgtggagctctccttgcagatcggtgacacagttcacatcctggagatgtacgagggttggtacagaggatataccctccaaaataaatctaaaaagggcattttccctgaaacatatatccatttgaaagaggcaactgtggaagacctggggcagcatgaaaccgtgattcctggcgagctccccctggtgcaggagctcacgtccactctgcgagaatgggctgtcatctggcgaaagctctacgtgaacaacaagctcaccctcttccgccagctgcagcagatgacgtacagcctgatcgagtggcggtcccagatcctgtctgggacgctccccaaggatgaactggcagagctcaagaagaaagtcacagccaaaattgatcatgggaacagaatgctggggttagatctggtggtgcgagatgacaatgggaacatcctagaccctgacgaaaccagcaccattgccctcttcaaggcccatgaggtggcctccaaaaggattgaggaaaagatccaagaagagaagtcaatcctgcagaacctcgatttgcggggccagtccatcttcagtaccatccacacctatggcctctatgtgaacttcaagaactttgtctgcaacatcggggaagatgcagagttgtttatggccctctacgacccagaccagtccacttttatcagtgagaactatctaattcgttggggcagtaacgggatgcccaaggaaatagagaagctcaataacctccaagcagtgtttacagaccttagcagcatggacctcatccggccccgcgtcagccttgtgtgccagattgtccgcgtgggccatatggagctgaaggaaggcaagaagcacacctgtggactccgaagaccttttggagtggcagtgatggatattactgatatcatacatgggaaggtggatgatgaagaaaagcagcattttattccctttcagcaaattgcgatggaaacctacatccgccagaggcagctcatcatgtcgcctttgataacatcacacgtgattggggagaatgagccactcacttcagtcttgaataaagtgattgcagcaaaggaagtgaatcacaaagggcaaggcctttgggtatccttgaagctcttgcccggtgacctcacccaggttcagaagaatttttcacacttggttgatagatcaacagcaatagcccggaagatgggctttcctgaaatcatactgccaggagatgttcggaatgacatttatgtcaccctgatccacggtgagtttgacaaagggaagaagaagacgccaaagaatgtggaggtgacgatgtctgtgcacgatgaggagggcaagctcttggagaaagcaattcaccctggtgctggatatgaaggcatttcagaatacaaatcagtagtctattaccaagtcaagcagccctgttggtatgagactgtcaaggtatccattgctatagaagaagtcacacgctgtcatataagatttaccttccgacacaggtcatctcaggaaaccagagataaatcggagcgagcatttggggtggccttcgtgaagctgatgaacccggatggcaccactctgcaggatgggaggcacgatctggtggtttataagggtgacaacaaaaaaatggaagatgctaaattctacctgaccctgcctggaaccaagatggagatggaagaaaaagagcttcaagcatccaaaaacctggtcaccttcaccccaagcaaggatagcactaaagacagctttcagattgccaccctcatctgctccacaaagctcacccagaatgttgacctgttaggcttgttaaattggcgttccaactcccagaacattaaacacaacctaaagaagttaatggaagtggatggaggagagattgttaagtttttgcaagatacactagatgcactctttaacataatgatggaaatgtcagacagtgaaacctatgacttccttgtgtttgacgcactggtatttattatttcactgataggagacatcaagttccagcattttaatcctgtacttgaaacctacatttacaagcacttcagcgccactttggcatatgtgaaactctccaaggtactgaacttctatgtggctaatgcagatgactccagcaagactgaactgctttttgctgcgttgaaagccttgaagtacttgtttagattcatcatccaatcccgagtgctctacttgagattttatgggcagagcaaagatggagatgagtttaataattcaattcgccagttatttcttgctttcaatatgctgatggacaggcctctggaggaagccgtcaagatcaagggggcagctttgaagtaccttcctagcataattaatgatgtcaaacttgtatttgatcctgttgagctcagcgtgctcttctgcaaattcattcaaagcattcctgacaaccagctggttcggcagaaacttaactgcatgaccaagatagtagagagcactctttttcgacagtcagagtgcagagaagtgctgctgccactgctgacagaccagctcagcggccagttagatgacaactccaacaagcctgaccacgaggcaagctcgcagcttctgagcaacatcctggaggtgctggacaggaaggatgtgggtgccactgcggtgcacattcagcttataatggaacggctgctgagaaggatcaaccggacagtgattgggatgaaccggcagtctccccacatcgggagttttgtggcttgcatgattgccctgctgcagcaaatggacgacagccactatagccactacatcagcactttcaaaaccagacaagacatcatcgacttcctcatggaaacttttatcatgttcaaggacctgattggaaagaatgtctatgccaaagattggatggtgatgaatatgactcaaaacagggtttttctccgtgctataaatcagtttgctgaagttctcacaagattcttcatggatcaggcaagctttgaacttcagctctggaacaattacttccatttggcagttgcatttctcacccatgagtcccttcagcttgaaaccttctcacaagccaagcgcaacaaaattgttaaaaaatatggggacatgagaaaggaaatcggctttagaatccgggacatgtggtataacctgggtccccacaaaatcaaattcatcccatccatggtgggtcccattctggaggtcactctgacccctgaagtagagctccggaaagccacaatccccattttctttgatatgatgcagtgtgagttcaatttcagtggaaatggcaatttccatatgtttgagaatgagctgatcacaaagctggaccaggaggtagaagggggcagaggagacgaacaatacaaggttcttctggaaaaactgctcctagaacattgccggaaacacaaatacctctccagctctggggaggtcttcgccctcctggtcagcagcctcttagagaacctgctggactatagaaccatcatcatgcaagatgagagcaaggagaaccgtatgagctgcactgtgaacgtgctgaacttttataaagaaaagaagagagaggacatatacataagatatctgtacaagcttcgagatttgcaccgagactgtgagaactacacagaagctgcctacacgcttctcttgcacgctgagcttctgcagtggtctgacaagccctgtgtgcctcatttgcttcagaaggacagttactatgtttatacccagcaagagcttaaagagaagctgtatcaagaaatcatatcatatttcgacaaaggcaaaatgtgggagaaggccatcaagctgagcaaagagttggctgagacttacgaaagcaaagtatttgactacgagggccttggcaacctcctgaaaaaaagggcctcattttatgagaacatcattaaggcaatgaggcctcagcctgaatactttgctgttggatactatggacagggctttccttctttcctacggaataaaatcttcatctatcggggaaaggagtatgagaggcgagaggacttcagcctgaggttgttaacccagttccccaatgcggagaagatgaccagtaccacgcctcctggggaagacatcaagtcgtcccccaagcagtacatgcagtgcttcactgtaaagccagtgatgagcttgccgcccagctacaaggataaacctgttccagagcagatcttaaactactacagagccaatgaagtgcagcagttcagatactcccggccgttccggaaaggagaaaaggatccagacaatgaatttgctacgatgtggattgaacggaccacgtatacgactgcatatacctttcctgggattctcaagtggtttgaagtcaaacagatttcaacagaagagatcagtcctctggagaatgccatcgaaaccatggagctgaccaacgagaggatcagcaactgtgttcagcagcatgcctgggaccggtccctctctgtgcaccctctctccatgctgctcagtggcatcgtggacccggccgtcatggggggcttctccaactatgaaaaggctttttttacagaaaagtacttgcaggagcatcctgaagaccaggagaaggttgagctgctaaagcgactaatagcattacagatgcccctgctaacagaagggatccgcatccatggggagaaactcacagagcagctgaagccgctgcatgagcggttgtcttcttgcttccgggaactcaaggagaaagtagaaaagcactatggggttataacactgccacccaacttgacggagaggaagcaaagccgcacggggtctattgtgctcccctacatcatgtcttccactctgcggaggttgtccatcacctcagtcacttcctctgtggtttccacctcttcaaactcgtctgacaatgctccttccagaccgggatctgatggctcaatcttggagccacttttggagcgcagggcctcgtcaggtgccagagttgaagatctgtcccttagagaggagaacagcgagaaccggatcagcaagtttaagagaaaagactggagtctgagcaagtcccaggtcattgcagagaaagcaccagaacccgatttgatgagcccaaccagaaaagcacaaaggccaaagagtctccagttgatggataatcggctatcaccatttcacggttcttcacctcctcagtcaacacccttgagcccacctccactcactcccaaagccaccaggaccctaagctccccatcgttgcagacagatggaatcgcggccactcctgtcccacctccacctccccccaaaagcaagccctatgaaggcagccagaggaactccactgagctcgctcccccactgcctgtccgaagagaagccaaagcaccaccccctccacctccaaaggctcggaagtctggcatccctacttccgagcctggatcccagtaaggatcttgccctccctgcaacaccgagtgccttagacagctgctgcctgagaactggcctccagccggtgtcctcattccatggggctccctgctgactgcatttcctgatctgggatgatgtttaccagcccaaaaccagtcatgttcttccaaaagcttctctttgatagaattttgaggccatgccacctcccttccagtccacatggaattccagaatcagtcacagcctctgattttttccaagaagagattgccttcaccattgttaaatgtcagcctgtacggcagagacatggtggtctgcacaagcctggacaagttcttccatattgatggtggagcaacccctgtaatctactccttggaaggattttttgctttgcttatgaaaagctgtgcttgagacttaggtacttttctcacgtggacacactgatcccatcccatattgcatcttggaagagatggatatcaagtacactttggtagctgaaataatcatatctttctgatgtctattgtatctcctttgaggaaaagaacacacatttttaatggagattggctgctttcaggtatgtgtgtctatcattgaaagagcatggactcaaacatcagccctgagttcttgagtccacccaactcccatcttcttgtggcacaggaaagctgccctctccctctcccaccacactcctgactaatggccttcactgcgtcgcagtcactccttccctacggacttctttgaagctcttccttttgcacatacggctttttttttttttttttttttttgtcctattacctcctctgagcgcaaatcactggctacaagggacttaccagtctggattcagcagtttcttttctaaaacccatttgggtgactcagcagccgcatctgctacctgattttatcctggagaatacagtgcaatatttctctttgattatttattcctcttgattgtggaattaatttgattgcttgctaatggtactagtagtactcctttcagaagaaaaaatggagcgatttaggtgaccaaatattacatacataaatagccacatgaagttttagacgtttggacttgaagcctcaaagatcaaccaaccagtccccttatttagtaaataaggaaattgaggctacacacagaaaattgtgctacagattattactaataacccagcttgctaaattaggctatacctaggtaatctctagaagacaactctgacagactctttaatatttacccctggttggaacaatatttgaaatgtcccagatatttctatgctacttagatatttgtggcaaagcagaaagctttttgactgtgaaggcagaggtcagcactgggggaaacttgctggtggtctctcccacaaccttgcccagagtcctttccactaaggaggtgaagagaacagagaaagagatttccatttctgctgccagagctggtatttgcctgcctgattctctgtgtttcctgtttcaccgccaccctttcaggagagaactacaccagttcatcatgagggtcagggaagcaaaagctctcagatgtgtccagggcgttacttaagaaatgagtatgcagattctggaaggggtgtggaaaaggtgatcctttacccccacccaggaaaacctgcattgtgctagcatggaagaatcatgggctttggaattaaacccatttggtggaattaaacccatttggtttcaaatcccagttatgacatctgttaactttgcaaactcacaaaaattatttgaaattatctgagttttcattttctcaccttccagaatggggataatgcctcctgcatcggttgttgtgaggtttcaatgagatgaaatatgggaaagaagaggtactcacctgatggtccctgctttcctctgctaggcctgagtaggaactggaactctctaagagcattactcatactttttttttcttccaaggtagtttggaatgtgagtgcaagttagttctgcacatacagcccttctccaaatggtggtttcctttgaggtcttttacatgattatttatgactagagacaaacttaataagaactcaagaggattttaaatggagagaactcaagctgtagagaaaggaggaggcaacagacaggatatgtaggggcttacctagagcctggcacgacttctgagaagtcacccagcagaccggctagaggggatttgtgtgccacactctacttgccgggctgccattaaaatagaaagatataaaactgggtcaccaaaaaaaccaaacctcaaggctatccttccagagcagtagaaatgagtcccacagcctggtctttgagcagaggctgggaagataggatacatcactgtctggataccttctctttttaatagaatatattccgtatgattccctttccaccttaatggaaataatagctctctcctgcctgaacaaaagggattccaggtagtattgtggctaagagattacagcggacgatggaaggttcattttttagggaaggtgttgggtaggaagagtcacatttgacagaattcataaataatgtgtcctgaagtcagaggatgactgcaaagaaacacctcatgattccattaaatataaagagataaggagcaaggaggaaaaaagagaaagaattggtctttatttttcttgctaagaactctctggagtattgaaagacattgaaattatccctaaaattgtcacaacttttgtgaatactggtatacggttggaggtgtttttaaatctttatttcctctctttctttgttctagtgacttgtcttgctttaagattttttttaaaggattgttttattcaacatatatcaagttcttatggaatgccagtcatggtactagccccttgggatgtagtggttgagtgtgttcaatggaaacagccccagtatacaaagacagttcactctggtgtgctgtaggattggaaagggagtggtaccagatgaaaatgaaaccctaaagaagactgctgggccatgagttgcttcctcctcctccaccttaaccctctgattccagaattgcagtcattttcttctgccaaggaaatccattaaaaactgcagccacactgcaatttcctaatgtagaacaagatataaagcaggctttgagacaacaacctacctttgtttactctttccaagctggaagagtccttctcctctagttgcccctaggtcactggctaatttattttaaaatttagatggaactcatgtatagttaagtgcacaaatcttagccgtgcagatgggtaattttcacatagctatttgcccacatccgtgcctctaagatagagacatacactgttttcagcaccccagaaagttcccacatgcccatggtgccattttgtgaaaggtatttataaggcccttcaaatttgtggcttcctttctcatacttctcaggtataatgaaagggggagaaaaaccccaccatcaacacaaaacaaggctataaagactgtgcaccttttaacaagtcaatttgtagtcagtccctgggcctgtctttttttttttttaattttgaagctacctgaggtttagaattccttcagccctagctgcttttattctgctttttatttaaacaaaaagagggggaggatctgaaggaaactagttttctgtacaaaggctttgaggtccatggactatacttgtcccatttatcatcccaggtggtgctttgaccctgccataccctggctattaagataaaaagatttgtggacattaaaattatgaatatgtcagtaataatccagcacacattgaaatattgacacagattaccataatttgtgcaacatcttataaacaatgtcatttccatagtagtctaaggcttcaccagcctggcccactgtatctagactttaggttcattttaataattatgctttccttctctgtatcatttgggaagttgataaatatcacttccttagataccttcattcagtgatatatctggcttttacaattaaattggaaaaggtaagtttctctttggtgggttgagagttggaccatcaattctaatctacaaaaggaaattcatgatttcactctgacgcctaggatctagccaaggctggtctgcagtatcagatgtccaaactcatctactattagccatattttgtgagtcgtttgtctaaactttgtcaaaaatgcctttgccatgattttgttgctatctggatttcaaacatggacagttaggaagatgtgcattgaagtaggaaaattttgttcagatttgctgttatttattttttaaattaaaaatggaaatgtattttaaagttta

SEQ ID NO: 525 - DNA, 1960 bp, Homo sapiens
tcctgtcactggcttatatggacacgtcagcccaccgtcacgtgaccgcaggctgctaaaaacagctccagcacccactccaaaccagggcctgaaacaatgtcctccaccgagagaaacgtaaaggacacttgatcacacaatccctggaataatatccaggaaacacttgctggagccactcgcagcacccttccctggcagcacacttggggacagcgaggagatgagcgcatctctgaattacaaatctttttccaaagagcagcagaccatggataacttagagaagcaactcatctgtcccatctgcttagagatgttcacgaaacctgtggtgattctcccttgtcagcacaacctgtgtaggaaatgtgccagtgatattttccaggcctctaacccgtatttgcccacaagaggaggtaccaccatggcatcagggggccgattccgctgcccatcctgtagacatgaagtggttttggatagacatggggtatatggacttcagaggaacctgctggtggaaaatatcattgacatctacaagcaggagtccaccaggccagaaaagaaatccgaccagcccatgtgcgaggaacatgaagaggagcgcatcaacatctactgtctgaactgcgaagtacccacctgctctctgtgcaaggtgtttggtgcacacaaagactgccaggtggctcccctcactcatgtgttccagagacagaagtctgagctcagtgatggcatcgccatcctcgtgggcagcaacgatcgagtccagggagtgatcagccagctggaagacacctgcaaaactatcgaggaatgttgcagaaaacagaaacaagagctttgtgagaagtttgattacctgtatggcattttggaggagaggaagaatgaaatgacccaagtcattacccgaacccaagaggagaaactggaacatgtccgtgctctgatcaaaaagtattctgatcatttggagaacgtctcaaagttggttgagtcaggaattcagtttatggatgagccagaaatggcagtgtttctgcagaatgccaaaaccctgctaaaaaaaatctcggaagcatcaaaggcatttcagatggagaaaatagaacatggctatgagaacatgaaccacttcacagtcaacctcaatagagaagaaaagataatacgtgaaattgacttttacagagaagatgaagatgaagaagaagaagaaggcggagaaggagaaaaagaaggagaaggagaagtgggaggagaagcagtagaagtggaagaggtagaaaatgttcaaacagagtttccaggagaagatgaaaacccagaaaaagcttcagagctctctcaggtggagctgcaggctgcccctggggcacttccagtttcctctccagagccacctccagccctgccacctgctgcggatgcccctgtgacacagggggaggttgtacccactggctctgagcagaccacagagtctgaaactccagtccctgcagcagcagaaactgcggatcccttgttttaccctagttggtataaaggccaaacccggaaagccaccaccaacccaccttgcaccccagggagcgaaggtctggggcaaatagggcctccaggttctgaggattcgaatgtacggaaggcagaagtggcagcagccgcagcgagtgagagggcagctgtgagtggtaaggaaactagtgcacctgcagctacttctcaggagttagtaatctgcctagcgcttttggcttttcttattcttcactacatctggagtcagattcagtgcttgatttttactttaatggattggatttgaggctcctcccctccagggacaggctgcagctccagcgagtggcagtggagctgattctgagccagctcgccatatcttctccttttcctggttgaactccctaaatgaatg

SEQ ID NO: 526 - DNA, 4697 bp, Homo sapiens
cacgggtgccgtggagtccatcgtcatcctgcccagccagtctgcggcggtgggctgggccgggtgattggtgtggtgaggcgtcttccatatcagcactgttgcttctcccctcttgcagtgcggcaccttcccgtctgatgctggcgttgtgcgtatggtgccctgacgtctgtccacgtgggcgcggaagcaaacagcgatgtcccagacgcaggactacgagtgcaggagccataatgtcgacctgccggagtcgaggattccagggtcgaacactcggttggagtgggtggagatcatcgaaccgcgcacccgcgagcgcatgtacgccaacctggtcaccggtgagtgcgtgtgggacccgccggccggcgtccgcatcaagcgcaccagcgagaaccagtggtgggagctgttcgaccccaacacgtcccgcttctactactacaatgccagcacgcagcgcacggtgtggcaccggccgcagggctgcgacatcatcccgctggccaagctgcagacgctgaagcagaacacggagtccccgcgcgcctcggcggagagcagccccgggcgcggcagcagcgtcagccgtgagggcagcaccagctcctccctggagcccgagcccgacactgagaaagcgcaggagttgccagcgagggccgggcggcccgcggcgtttgggacagtgaaggaggacagcggcagctcttcaccaccaggagtgttccttgagaaggactatgagatttaccgggattacagtgcggacggccagcttcttcactacaggacctcctcgctgcggtggaactcgggcgccaaagagcgcatgctcatcaaggtcgctgatcgggagcccagcttcctcgccgcccagggcaatggctacgccccagacggcccacctggggtccgctcccgcagaccctccggcagccagcactcacccagcctgcagaccttcgccccggaggctgacggcaccatcttcttcccagagaggaggccgtcacccttcctgaagagggccgagctcccagggagcagctccccgctgctggcccagccccgaaagccctccggggactcgcagccctcctccccgcgctatggctatgaacccccgctctacgaggagcccccagtggagtaccaggcccccatctacgatgagccccccatggacgtgcaattcgaggctggcgggggctaccaggccggctctccccagcggtcgccgggccgtaagccccggccgttcctccagcccaacaagcagggccccccctcgccctgccagcagctggtgctcaccaagcagaagtgtcccgagcgcttcctgagcctggagtacagtcccgccggcaaggagtacgtgcggcagctggtctacgtggagcaggcgggctccagccccaagctgcgcgccggcccgcggcacaagtacgcgcccaaccccggcggtggttcgtactccttgcagcccagcccctgcctgctgagggaccagcgcctgggcgtcaagtccggagactacagcaccatggagggacctgagctgcggcacagccagccgcccacgccgctgccacaggcccaggaggatgccatgtcctggtccagccagcaggacaccctgtcctccacaggctactccccgggcacgcgcaagcggaagagcagaaagccctctttgtgccaagccaccagcgccacccccactgagggccccggggacctgcttgtggagcagcccctggccgaggaacagcccccgtgcgggaccagcctcgcccccgtgaagcgagcggaaggtgaggccgaaggggcgcggggcgcggccgagcccttcctggcgcaggctcggctggcctgggaggcgcagcaggcccacttccacatgaagcagaggagcagctgggactcccagcaggacggctctggctacgagagcgacggcgccctgccactgcccatgcccgggccggtggtgcgggccttcagcgaggacgaggcgctggcccagcaggagaacaggcactggaggaggggcaccttcgagaagctaggcttcccccagatcctgctggagaagagcgtctccgtgcagaccaacctggcctcaccagagccctacctccacccctcacagtctgaggacctcgctgcctgtgcccagttcgagagcagccggcagagccgcagcggcgttcccagctccagctgcgtcttccccactttcacgctgcgcaagccctcctcggagacggacatcgagaactgggcctccaagcacttcaacaagcacacgcagggcctcttccggcggaaggtgtccatcgccaacatgctggcctggagcagcgagtccatcaagaagcccatgatcgtgacaagcgaccggcacgtgaagaaggaggcctgcgagctcttcaagctgatccagatgtacatgggtgaccggcgggccaaggccgacccactgcacgtggccctggaggtggccaccaagggctggagcgtgcagggcctgcgggacgagctctacatccagctgtgccggcagaccaccgagaacttccgcctggagagcctggcccgcggctgggagctcatggccatctgcctggcctttttcccgcccacccccaagttccactcctacctggaaggctacatctaccggcacatggaccccgtcaatgacactaaaggggtggcgataagcacgtatgccaagtactgttaccacaagctacagaaggcagccctgaccggggccaagaaggggctgaagaagcccaacgtggaggagatccggcatgccaagaacgccgtgttcagcccgtccatgttcggcagcgcactgcaggaggtcatgggcatgcagagagagcgctaccccgagcgccagctgccctgggtgcagacacggctctctgaggaggtgctggcgctcaacggtgaccagacagagggcatcttcagggtccctggggacattgacgaggtgaatgccctgaagctgcaggtggaccagtggaaggtgcccacaggcctggaagacccccacgtccctgcgtccctgctgaagctgtggtaccgggagctggaggagcccctgatcccgcacgagttctacgagcagtgcatcgcgcactacgacagccccgaggcggcggtggccgtggtgcacgcgctgccccgcatcaaccgcatggtgctgtgctacctcatccgcttcctgcaggtcttcgtgcagccggccaacgtcgcggtcaccaagatggatgtcagcaacctggccatggtgatggcgcccaactgcttgcgctgccagtccgacgacccgcgcgtcatcttcgagaacacccgcaaggagatgtccttcctgcgggtgctcatccagcacctggacaccagcttcatggagggtgtgctgtagcgggggcgcccggggacaggagggatgtcctgccgcccccagccaggccgaactccgcactcgctctcccggcagaggggccagaatcgcccggcccagccctggagccccctccactcccccaggcccctggccccggcgctccccacgtcttctgcctggtctgagggtgcagccagggcacagcagcggcggggagggcgcctctggccccccacctcacggccagttcccgcgggcaccgcctcgccctccgctggccgcgggtcagctccgagaaagtgccttctgtgtcctggagccgagcgacgctgcctccttggggccgggctgcctccctgtggctcctgcgcgccctggcctgggccttgcccagccgccccggtctctccttccctttctcctgtcctcgtcctggcctgcagctcttcccagccccgagagagcttcccgacctgtccccgcctcctctccctccctcggcccgtggtccccagctggtgactgctcaggagtttgggggctccaggacagtgggcccggggcctggcaggctctcggtgggtggggtgggggcccccaaaccaaagtcctctggggtagggagcagggctgggcaggcattctgggggcagggtgggggaggggcgagagtatttttttcttcgtgtaactgtaaatccagaatctatcctgcatcgcagcccaccgtgtatagagatataaatagagggaaagatataagaactaaatttgctaatgacatagttttaacctaaatgctatttatctctgagccgtccccgtcctccgtgcagagcaagttgaggtcattccttcttttcttctccgatcttttttcttggcttctgaccaaaaaccaagctctaccccatccccatcccagacctgcaggagacgagcgagcgggaaggcgccgggcccgggactgtccgttctcggggccagagctgctgggggaccgagtttgtacattttccattttggaattttgagttccaattgttgtaaaacttaatttctccccagtttttatatatatattttttagagttccgtttttatttattaaaaacaaaagccccagccctgccgaggcctgggcggcgtcctcagtcgggtggtcccggggcctttgcggtcccgcccggctgagacgctcgccccgacgcatggacccgagaggcgacgacacgagtgaataaagtgcacatggaccctg

SEQ ID NO: 527 - DNA, 1614 bp, Homo sapiens
gcgcagaggggcacggccctcactgccccggccggggcgagagcggctccgcccctcgagcgccgggtaggccggggccggcggggcccggaaggcgacgggaaggagccgagcttgggttatggcggcgccgggcgcgctgctggtgatgggcactctcactctgtcgcccaggctggagtacagtggcgtgatctcggctcactgcaacctctgcctcctgagttcaagcgattgtcatgcctcagcctccggagtaactggggttacaggcgtgcaccaccacacccagctaagttttgtatttttagttgagacggggttttgccatgttggccgagctagtcccgaactcctggcctcaagtgatccgcctgcctcagcctcccaaagtgctgggattataggcgtgagccaagggctcaacctaacttggtcttaagtgtgatttctgctatgcacacttctggcttcaccagccatggagtttggccgggatggtctactcatccgtaggctgcatgtctccctgcgcagccttcaatagaatgaactaatgggaaaggtttcactgctctcgcaacctttggttacatccaggagcagatctcagtttggtacaactgtgtctaacacctctctgatagctttttagtgaaagaaagaggacctttgttaggcaacagtatccagctagaatttaatcacattgttctgttttcattatatacagcttttcaggtaccttctattcaagatccaccgtgggcgccctgctggcatctgagctgggatggaaattctatgatgctgatgattatcacccggaggaaaatcgaaggaagatgggaaaaggcataccgctcaatgaccaggaccggattccatggctctgtaacttgcatgacattttactaagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgccccctgaattattgcagtcccagtttgagactctggagcccccagcagctccagaaaactttatccaaataagtgtggacaaaaatgtttcagagataattgctacaattatggaaaccctaaaaatgaaatgacaatgattttgtatcagtggtccaaacagaactaagcataaatcattgtgccatcccaaacctcgttccagccgccttgcccatactagattctaaatgtttctaaaggcaaaccccaatgtgtcaagacagacttgtttaggtgtaattttaggaattatgctggttcatcaggaagcagagggggagttttaaaagtcaagcttaaattgaagtttaaattcatctataaccaaatcaaatgatcagaggaaattctgtaatcaatgctggaaatcgttacattgtttagaacattcttgctcatgcctgtatttgcacaaataaatgaaacttcgctgtc

SEQ ID NO: 528 - DNA, 1966 bp, Homo sapiens
agtaaccccgagtctgcggaagtggtgacccgtgggacgcggctgagacaggagactgaaaggaaccataatttgtgacatcagttgttttctttgataagcagctatttatgattctggaagattaaggcagataggaaaccccatctgagattttaataaatccctcaaacaataaaccacatcatggacatacagctggaccctgccagagatgacctgcctctcatggccaacaccagccacatacttgtgaagcactatgtactggatttggatgtggattttgaaagtcaagtcattgaggggaccatagtgcttttcctcgaggatggaaacagattcaagaaacagaatagctctattgaggaagcctgccaatcagaatcaaacaaagcctgcaaatttgggatgcctgaaccctgccatattcccgtgacaaatgcaaggaccttctcatctgaaatggaatataatgattttgcaatctgtagtaaaggtgaaaaagatacttctgataaagatggtaaccatgacaaccaggaacatgcttctgggatttctagctcaaagtactgctgtgacacagggaatcatgggagtgaggattttttgctagtgttggactgctgtgatttatctgtgttaaaagtcgaggaggtggatgttgctgctgtgccaggtctggaaaaatttacaaggtctcctgagctcacggttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagcccacacatcatgttcctctctcagagcatcttgacaggagggaaccatctctgtgggacccgcctctgccatgaaattgcccatgcctggtttggcctagccatcggggcccgagactggacggaggagtggctgagtgaaggcttcgccactcacttggaggatgtgttttgggccacagcacagcagctggccccctatgaggcccgggagcagcaggagctgagggcttgtctgcgctggcgtcgcctccaggacgagatgcaatgctcccccgaggagatgcaggtgttaaggtttccacatgttggcggatgcagtggaagcttctcttgagatctttgccacactgttcaacatgtttgaccactctgtcctaaaaacgctttcttcttaaagcactttctcctcctgg

SEQ ID NO: 529 - DNA, 2330 bp, Homo sapiens
cttccggcgggggcgcggcttggactgaggagcggacccggccgggcgcaggggctggactggcggagcaggtggggtccgcggccgccggagcgttccggtcggcgtctgggcatctcggcctcggcagaaagcgcgacggccctgctgcgcggggcccgcggcgatgccgttcctgcacggcttccggaggatcatcttcgagtaccagccgctggtggatgcgattctgggctccctggggatccaggaccccgagcggcaggagtctctggaccggcccagttatgtcgccagcgaggagagccgaatccttgttctcactgagctgctggagaggaaagcccactctcccttttaccaggaaggcgtgagcaacgccctgctcaagatggctgagctggggctgacgcgggcggccgacgttctcttgcggcatggggccaatctcaactttgaagacccagtcacctactacacggccttgcacatcgccgtcctgcggaaccagccggacatggtggagctgctggtgcatcacggggccgacgttaatcggagggaccggatccacgagagtagccccttggacctggccagcgaggagcctgagcgcctgccctgcctgcagcgcctcctggaccttggagctgatgtcaatgccgctgacaagcatggaaaaactgctctgctccatgctctggccagcagcgacggggtgcagatccacaatactgagaacattcgtctcttactggaaggaggggcagacgtcaaggccaccaccaaagatggggacacagtgttcacctgcatcatcttcctgcttggtgagaccgtgggaggggacaaagaggaggcccagatgatcaaccgcttctgcttccaagtcacacggctgctgctggcacacggggccgaccccagcgagtgcccagcccacgagtccctcacccacatctgcctgaagagctttaaactgcacttccctctcctgcgcttcctcctggagtccggagccgcctacaactgctccctgcacggtgcgtcctgctggtctggctttcacatcatctttgagaggctctgttcccacccaggctgcacggaagacgagagccatgcggacctcctgcgcaaagctgagactgtcctggatctcatggtgaccaactctcagaaactccagctgcccgaaaacttcgatatccaccctgtgggcagcctggcggaaaagatccaggccctccacttctccttgaggcagctggagagctatcccccgcccctcaagcacctgtgccgtgtggccatccggctctaccttcagccgtggcctgtggatgtgaaggtcaaagccctgcctctgcccgacaggctgaagtggtacctccttagcgagcacagtggctccgtggaagatgacatctgataggtctcaggctacaggaacgggggacacgggcagctcaggtcagcctgttggtagatgctgggacagcattagaagagggtctttttgatctgggagatgagacgggatccttcatgagaaaagccagccaggtagagcctgaagctgtgatcactccagtggtgaagggtgcagctctggttcttccagagagactgcccccttccctccagcggcactccaagtcccccccatgttggaaagaggaacagggcttggattgatgtttataccctctgaattggagggcagtgccagggcatttgcagaagctgggaaggaccaagcctcagcaccccagggctgcggggctcttgttggccgcacgtggcagtgcagctggagaggaagcctggggcacgtcctgtgcggtgccaccaaggccccacccctgccccttttccttccaggttctgttactcacagaagtgtttctggtgggctctgcgggagaagacactaagggccccacaggcttgtttcatggtgttgcaagccaagctggcccctgcctgttcctgtagctctggggccaggtcagccgtggccccacctaccagaactgtgctctgctggcagctgtgcttttgccaaacccagggcctcagcgaccatgacttctgctaaaaagcaatcatgagtgcgtggctggggacagacctctctgaagtgtctcctgttgtgaggggctcactttggagccactgaagagccgactgtgccacccacttgcgagcctcagtcccttccaagctgcactggtcattgggaattgtgtaaacacctctggggataagctgaggtgactaaatgatatatttatattataagattaaactgactttcttggccttaa

SEQ ID NO: 530 - DNA, 2180 bp, Homo sapiens
ccgggcgcaggggctggactggcggagcaggtggggtccgcggccgccggagcgttccggtcggcgtctgggcatctcggcctcggcagaaagcgcgacggccctgctgcgcggggcccgcggcgatgccgttcctgcacggcttccggaggatcatcttcgagtaccagccgctggtggatgcgattctgggctccctggggatccaggaccccgagcggcaggagtctctggaccggcccagttatgtcgccagcgaggagagccgaatccttgttctcactgagctgctggagaggaaagcccactctcccttttaccaggaaggcgtgagcaacgccctgctcaagatggctgagctggggctgacgcgggcggccgacgttctcttgcggcatggggccaatctcaactttgaagacccagtcacctactacacggccttgcacatcgccgtcctgcggaaccagccggacatggtggagctgctggtgcatcacggggccgacgttaatcggagggaccgggaaaaactgctctgctccatgctctggccagcagcgacggggtgcagatccacaatactgagaacattcgtctcttactggaaggaggggcagacgtcaaggccaccaccaaagatggggacacagtgttcacctgcatcatcttcctgcttggtgagaccgtgggaggggacaaagaggaggcccagatgatcaaccgcttctgcttccaagtcacacggctgctgctggcacacggggccgaccccagcgagtgcccagcccacgagtccctcacccacatctgcctgaagagctttaaactgcacttccctctcctgcgcttcctcctggagtccggagccgcctacaactgctccctgcacggtgcgtcctgctggtctggctttcacatcatctttgagaggctctgttcccacccaggctgcacggaagacgagagccatgcggacctcctgcgcaaagctgagactgtcctggatctcatggtgaccaactctcagaaactccagctgcccgaaaacttcgatatccaccctgtgggcagcctggcggaaaagatccaggccctccacttctccttgaggcagctggagagctatcccccgcccctcaagcacctgtgccgtgtggccatccggctctaccttcagccgtggcctgtggatgtgaaggtcaaagccctgcctctgcccgacaggctgaagtggtacctccttagcgagcacagtggctccgtggaagatgacatctgataggtctcaggctacaggaacgggggacacgggcagctcaggtcagcctgttggtagatgctgggacagcattagaagagggtctttttgatctgggagatgagacgggatccttcatgagaaaagccagccaggtagagcctgaagctgtgatcactccagtggtgaagggtgcagctctggttcttccagagagactgcccccttccctccagcggcactccaagtcccccccatgttggaaagaggaacagggcttggattgatgtttataccctctgaattggagggcagtgccagggcatttgcagaagctgggaaggaccaagcctcagcaccccagggctgcggggctcttgttggccgcacgtggcagtgcagctggagaggaagcctggggcacgtcctgtgcggtgccaccaaggccccacccctgccccttttccttccaggttctgttactcacagaagtgtttctggtgggctctgcgggagaagacactaagggccccacaggcttgtttcatggtgttgcaagccaagctggcccctgcctgttcctgtagctctggggccaggtcagccgtggccccacctaccagaactgtgctctgctggcagctgtgcttttgccaaacccagggcctcagcgaccatgacttctgctaaaaagcaatcatgagtgcgtggctggggacagacctctctgaagtgtctcctgttgtgaggggctcactttggagccactgaagagccgactgtgccacccacttgcgagcctcagtcccttccaagctgcactggtcattgggaattgtgtaaacacctctggggataagctgaggtgactaaatgatatatttatattataagattaaactgactttcttggccttaa

SEQ ID NO: 531 - DNA, 1359 bp, Homo sapiens
gagttccacatctgatacccaggagtctccagcttccaagagaggtcgggtcacagccagcagctatgtctgacataaatcttgactgggttgacaggcgtcagttgcagcgcttggaggaaatgctgattgttgtggatgagaatgataaggttattggtgccgacaccaagaggaattgccatctgaacgaaaacattgagaaagggctgctgcaccgagccttcagcgttgtcttgtttaacaccaagaatcgaatcctgatacagcagaggtcggacacgaaagtcacgtttcctgggtattttaccgactcctgtagtagccacccattatacaacccagcagaactggaagaaaaggatgccatcggagtgaggagggcagcccagaggcgtctgcaagcagagctgggaattcctggggagcagatttctccagaggacattgtgttcatgacaatctatcaccacaaggcaaaatcagacagaatttggggagagcatgaaatttgttaccttctgcttgtgaggaaaaacgtcactctgaacccggatcccagtgaaacgaaaagcatcctctacctgtcccaggaggagctgtgggagctgctggagagggaggcgaggggtgaagtcaaagtcaccccctggctaagaaccattgccgagaggtttctgtaccggtggtggcctcacctggatgacgtgaccccgtttgtggagcttcacaaaatacacagagtgtgagaggcagggaggtcgagtcagccatgtgtaatgccctcagtgcaggcagacgcaccattgaggcaatgatacaccctctccaaaaaacagggcaaaaggggcacttgattgcccatcatgtataaatcactatttcaaccttttcatcaactttgtcatatcttcattttcccttttccttatttccatatttctcatctgcctggttgcagggaggaaatttaacatttcctttgtcccaatttccattttataagcacttgtttgattaacagcagctgatcctgaaagtcttggggagatcttgagagtcctgaagcaggcggactagcctggctggaccatgaggctgtctccccacagctttatccaagcctccaaggtcaggatgggatctctgtatcatgtttttctttttaaatcacttatttcagagtgcaacacaaggctgcatttttaaaaaaaagacacattcaatcttgcatcctaatacaagcagtacggaagatgcgtatggtctcagccaagtgactcgacgtttatccacttctgttcatttgatcgtttcagtaatatgcttacaaataaagacatacttgctttaaaacat

SEQ ID NO: 532 - DNA, 1850 bp, Homo sapiens
cgcggcgcggcgccggaggaggaagtggtgaggttgttgctccttcagcgcctatcgctggctcttggggcgcagagaggggccgcagtctccgcggctgcgtcgagctcccttgcagtcccctccatgttccccggcgccactactccccttcctaaggccgccgcttaccccggggtctatggaagtaatggaaggacccctcaacctggctcatcaacagagcagacgagcagaccgtttattagctgcaggcaaatacgaagaggctatttcttgtcacaaaaaggctgcagcatatctttctgaagccatgaagctgacacagtcagagcaggctcatctttcactggaattgcaaagggatagccatatgaaacagctcctcctcatccaagagagatggaaaagggcccagcgtgaagaaagattgaaagcccagcagaacacagacaaggatgcagctgcccatcttcagacatctcacaaaccctctgcagaggatgcagagggccagagtcccctttctcagaagtacagcccttccacagagaaatgcctgcctgagattcaggggatctttgacagggatccagacacactactttatttacttcagcaaaagagtgagccagcagagccatgtattggaagcaaagccccaaaagatgataaaacaattatagaggagcaggcaaccaaaattgcagatttgaagaggcatgtggaattccttgtggctgagaatgaaagattaaggaaagaaaataaacaactaaaggctgaaaaggccagacttctaaaaggtccaatagaaaaggagctggatgtagatgctgattttgtagaaacgtcagagttatggagcttgccaccacatgcagaaactgctacagcctcctcaacctggcagaagttcgcagcaaatactgggaaagccaaggacattccaatccccaatcttcctcccttggattttccatctccagaacttcctcttatggagctctctgaggatattctgaaaggatttatgaataattaaaatggaaggccacagaaaaggggaaaagaggaaataatacagtaatcgttaatccagcaaaaagaaatgaaaagggaaaaccacatagaagggtaatcccggaaatgcttcatctggtggactgtgggagcagaggcattgccaggacttgggaaacagtcactgtgaaatgcgctgcgtatctcattcactcacttcagctaatgattccgacttggcagacgctaaactcatggaggttcggtttctcctgatacaaaccaaatggctacctggaagaatttctttcaagcaacagttatttttcttatcttcagggttaaaatgtataaaagttatgtgtaattaatctataatgccataaatgataatgcaaaacctaaataatatggtggccggaggggctgccttatatttgaaacatgctttctatcatgcattgactgtatgcattttgttaatgcacattctgtttgtttaaggtgtgtaagatacacacccttctagatgaaactatatgtgccacactttgcactactcataatgataacctcaagactatcagaagaaatatttaaatttccattttatgaagaaaggaaccaaattattatgctttttaaaacaaattaccagtttacataattaatcagggtgcattttaagttctaacttcgtttattgtataatgcatcatttgaaaataccaaggaggaaataccctttgtttttaatgatgcaagagtggacgtaatgctagttggcagtattttattgtaagaaatcaataaagtaattgtgtttt

SEQ ID NO: 533 - DNA, 4362 bp, Homo sapiens
gtggttagtagcgataaatgctctgaaggaaaaaacatacagtactgtgagaatgtagtattttgaaatgtttcatttgcaaaattgtacttgatactcagaatagtgtttttttttcctaaaatacttaatatgctgaacaggtcaatgtatcatctgcctagtatgcataaacaataacagtaaatgtttagtaatttgagcacagttgggtatgttcatgtattttttattccttactctgtttgcattgccagtgtttgattttgctatttcaaagaaatggcattttgttgagtttgaaaatttgaaggtgcattggatcctgctaatttgttggattctgctaaattgtagcagtacagctctcaggttttgtagttaagagcataacttcactaaataaaaatatttttaatacaataatatggaatcagagtaactctcctttttcctgctcaaactttgatttgctgaagctgcttcccgaaaatcatgtgtgtcgactctctggtcagaatttgctccggactctcttatggcagaatcagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagcccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatggatgtcaaccatggattaactgagttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgataccagtacagtttctatggttgtaattgaacttgaacagacttttaaaggttaaaaattatgatttaaatcttactctgagactctataaaaagaaaaaaaaggtagcatggtggaaacactatcttttcttttttgctagaataagtgtctttgtgcaaacctaaatcacagatagggaatatactacataacctgcagttcttttctttgtgaatcctgacacactgatagatgggggattgtcgatcagagaacttattaatatttagtactggaagaactctgtctccacagttgccagtaataaaaagaaacattggctactatgagcaccaatcactgggttatagctttcaaaattattgatgctgcagtgctttagagctatttccttgaatttaagaaacaaatcttaacagttttatggtgctgatgcttagttgtctcatgccattaaattgtaaaagtgagttgatgcaatacatgtgactttctgctataatgcaaatatttattttttaaatttattttaaaatgccgtgaaaactgtttaataaagatttattgttttaatattt

SEQ ID NO: 534 - DNA, 2623 bp, Homo sapiens
atgccaagatgcctgccttccttggtctaaagtgtctggggaaattgtgcagctctgagaaaagcaaagtcacctcatctgagagaaccagtgccaggggctcgaacagaaagagactgattgttgaggaccggagggtctctgggacctccttcaccgctcataggcgtgccactatcactcatttgctgtatctctgtcccaaggactactgcccacgtgggcgtgtatgtaacagcgttgatccttttgtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggctgccaaacattcggcgttcttcatccgatttcttttattccaaaagtctgattcgacgcacaggacggtctccgtctctgcagcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgagcttttgtctcctggtgtgcagaggttgtcgtacctgcgcaccagcagcctcagccccacccacagcgactcccgccccaacccccctttccgacaccacttcattccccatatcaaaggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggccca

SEQ ID NO: 535 - DNA, 1109 bp, Homo sapiens
aagccccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaaaactttcaaagacgactagcacagaaccctctcttttggaaaacataatttgaataaaataatttttaatggattctgaaatttgtcatgttttgaagataactgactccatctaaaagtatgaggtcaaaggatcacgaaacctaagtttaaaaactgcttagagactgaagcttaattaaaaatctttattaaaaattaaaaacattgaaaaatgaaaatatgttcatcattaaagacttttttccccttaagcttaaaataccattcaaaggcaagacattttgttttggctatgattcattttttttacttaaaaataaaacctataccaaac

SEQ ID NO: 536 - DNA, 2955 bp, Homo sapiens
atacaatgccgcaaagcgcagggctgatctccgtctccgcccccagctgctttctccgagaggaggtggctgagtcgggggcgggctgggagggctgtcggtgggccagtctgcgtagcgacggcccgtcccctgcgcacggacgccgggaagaagggggtggggccacgtttgcgtccgcgccatcaggcccgagatagcggcgaggtccgctttcagtgtatggttttccctgccaaacggttctgcttggtgccatccatggagggcgtgcgctgggccttttcctgcggcacttggctgccgagccgagccgaatggctgctggcagtgcgatcgattcagcccgaggagaaggagcgcattggccagttcgtctttgcccgggacgctaaggcagccatggctggtcgtctgatgataaggaaattagttgcagagaaattgaatatcccttggaatcatattcgtttgcaaagaactgcaaaaggaaaaccagttcttgcaaaggactcatcgaatccttacccgaatttcaactttaacatctctcatcaaggagactatgcagtgcttgctgctgaacctgagctgcaagttggaattgatataatgaagactagttttccaggtcgtggttcaattccagaattctttcatattatgaaaagaaagtttaccaacaaagaatgggaaacaatcagaagctttaaggatgagtggactcagctggatatgttttataggaattgggcacttaaggaaagcttcataaaagccattggtgttggactaggatttgaattgcagcggcttgaatttgatctatctccattaaacttggatataggccaagtttataaagaaacacgtttattcctggatggagaggaagaaaaagaatgggcatttgaggaaagcaaaatagatgagcaccattttgttgcagttgctcttaggaaacccgatggatctagacatcaggatgttccatctcaggatgattccaaaccaacccagaggcaatttactattctcaactttaatgatttaatgtcatctgccgttcccatgacacctgaagatccttcattttgggactgtttttgcttcacagaagaaattccaatacgaaatggtacaaagtcatgatgattccctgagtaacaaagggaaatgaaaactgtttgtgatcttccgtattcactgaaaaataaatgcttgtttagtatcaaattttatttcacgaaagtttttttaaagaacagaaacttttccaattaaaaaaaaaaagcagacttctggttcaagatagctcactggaatacatgtttacctctttctttcctaaattgcattgaattgataggaaggatggcggaatcttaaagtgatacatgctaactgtagaaaaaaatagaaaatgcacataagcaaaaggaaacatttaaatgctatctttcaaagataactactcttaaaaccttgagtatcttttcagacctttttcttggcaaatgaatccatattgacatatttgatttttttaaaaacatggaaacgtactgttttgtaaattctttttaactgcacatctactgttcataaatatacctctgtaacataactttttgtggttctaatgtactctgttgtatagctaatacaagttaggatgcttttggccagaggtaacagtgtccaaatataattggcctaagtaacctaggaaattgtttgacataacacagggttcaggggtgtcattaaagacacactttttttgccttgacctcagttggtttgttttgccttaggctattccacctctcgatcacaagagctgctgctataacttccagttttacatctttgtaaaattgtatctcaaaggcagaaaaggccatttcgtctctcatttgttttatccatgaggaagatttttaacaaaagcctccagaagatttcccctcagtttccattgacttagatcaggttacagagaaaggcaatgtctgacatttttggtctctgttagaagtagactctgttgaaaagaaagaagctaagctaggtgtgaagaatggaattggaagcccactgccttcccataagaaaggtttaccataatttactcacttttttctgtgttagacattttgattatctgcagtttattactacaagcagtggcagagtgaatgtccttgtacattttgagttacatgcttaattatgtccttgagaaagtttctaaaagtggaatgattggtttgactggttcatagggctttaattatacaatttacccctctaattagtactatatgtatgtgacttccctccccctgccagaatactccttggtcaattgtaggtattctttttggtttaatttttgccaatgtaattaaaaaatggtatgtcatttttaaaatttgtatttctttcattacaaataagattgttatgtcagtattgttattggcttttcgtattcctcttaacgtgaaccgtctgttcattgtttttacctgttttcgttttagcaagtagtacttaatttaaagtgtgaacttaatatataagatgccaggaccatcatattgatgacaaaaatctattatgtggttgtagtgcatgtcttggagttaaactcttaagtatcaagaagtaaaataatttcattgtttctgttactaacattaaaagtgtgcaaattgtataaaattaggtacttcgattagtaaaagaaaaaaatttgaatgttttttttttttattttattaagcatgcccagttatgccaagcatagtaaataaaggtcaagtagcatttataatagaggaagtattgttatccctagcatgagtgtaatggtgatatgaaaaactttgtcttgtcattataataataaaaaaatgaacatttattatggaatttctatgagcctga

SEQ ID NO: 537 - DNA, 2164 bp, Homo sapiens
gccgggccggagcggggtgggtaggggacgcgaggcggagcggggccccacacaggccgcggcggctggctcgggcccctacggtcccggcggcggctggaggaggaagccaggcggctggcggaggaggagagacggaggaggccgagaccggagcgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacagagagctcaaagacagcgcatggaagctccacaaagcagcagcctggtcaccttttctcttccaagtgcccagaacagcccctggatgctaacaggggcgccgtaaagcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcccctcagcttctctctggttttctca

SEQ ID NO: 538 - DNA, 3927 bp, Homo sapiens
gaggggtcgagcctgggcagtacaggcggcggtgcgcactctgcggcggcctctgcgcctcgggcgggcgggagagagaggccgcggccgccagcgtggggatgtctaggagctcgaaggtggtgctgggcctctcggtgctgctgacggcggccacagtggccggcgtacatgtgaagcagcagtgggaccagcagaggcttcgtgacggagttatcagagacattgagaggcaaattcggaaaaaagaaaacattcgtcttttgggagaacagattattttgactgagcaacttgaagcagaaagagagaagatgttattggcaaaaggatctcaaaaatcatgacttgaatgtgaaatatctgttggacagacaacacgagtttgtgtgtgtgtgttgatggagagtagcttagtagtatcttcatctttttttttggtcactgtccttttaaacttgatcaaataaaggacagtgggtcatataagttactgctttcagggtcccttatatctgaataaaggagtgtgggcagacactttttggaagagtctgtctgggtgatcctggtagaagccccattagggtcactgtccagtgcttagggttgttactgagaagcactgccgagcttgtgagaaggaagggatggatagtagcatccacctgagtagtctgatcagtcggcatgatgacgaagccacgagaacatcgacctcagaaggactggaggaaggtgaagtggagggagagacgctcctgatcgtcgaatccgaggatcaggcatcagtggacttatcgcacgaccagagtggggattccctcaacagtgatgaaggagacgtgtcttggatggaggagcagctgtcctacttctgtgacaagtgccaaaaatggataccagccagtcagctgagggaacagctcagttaccttaagggtgataatttttttaggtttacttgttcggattgctcagcagatggcaaggagcagtatgaaaggctgaagctgacatggcagcaagtcgtcatgttggcaatgtacaacttgtctctggaaggaagtggacgtcaaggttatttcaggtggaaagaagatatctgtgcttttattgagaaacattggacttttttactagggaataggaaaaagacgtctacctggtggagcaccgtggcaggttgcctcagcgtgggaagtcccatgtacttccgttcaggtgctcaggaatttggagagccaggatggtggaaacttgttcataacaagcccccaacgatgaaacctgaaggagagaagttgtctgcctctactttgaaaataaaagcagcctcaaaaccaactttagatcccatcattactgttgagggacttagaaaacgagcaagtcggaatcctgtggaatctgccatggaattaaaagagaaaaggtctcgaactcaggaagcaaaagacattagaagagcccagaaggaggccgctggctttcttgacaggagcacatcttctacccctgtaaaattcataagccgaggccgcaggccagatgtgattctggaaaaaggcgaagtgattgacttttcctccttgagctcctctgaccgcaccccgctgacaagcccatctccttctccttctctggatttctctgcccctggtacacctgcctctcattctgccacacctagcttgctttcagaagcagatctgattccagatgtgatgcccccacaagccttgtttcatgatgacgatgagatggaaggcgatggagtcatagacccagggatggagtacgtcccaccccctgctgggtcagtagcttctgggccagtggttggggtcagaaagaaggtcagaggccctgaacagataaagcaggaggtagagagtgaggaggaaaaacccgacaggatggatattgacagtgaagacacagattcaaacacatctttgcaaacaagggctagagaaaagaggaagcctcagctggagaaggacacaaagccgaaagagcccaggtatactcccgtgagcatctacgaggaaaagctgctgctcaagaggctggaagcttgtcccggtgctgttgccatgactccggaagctcggagactgaaacgcaaactgattgtcagacaagcgaaaagggataggggattaccactttttgacttggatcaagttgttaatgctgctcttttgttagttgacgggatttatggagccaaagaaggaggaatttccagacttccagctggacaagccacgtacagaaccacctgtcaggacttcagaatccttgaccgataccagacttccttgccgtccaggaagggatttcgacaccagaccaccaagtttttgtatcgcttggtaggatcagaagatatggctgtggaccagagtattgtcagcccttatacctctcggatcttgaaaccttatatcaggcgtgattatgaaacaaagccacccaaactgcagctcctgtcacagattcgttcccacctgcacaggagcgaccctcactggacgccggagcccgacgcacctctcgattactgttatgtgcggccaaatcacatcccaacgatcaactccatgtgtcaggagtttttttggcctggcattgacctgtctgagtgtctgcagtacccagacttcagtgttgttgttctttataaaaaagtcatcattgcctttggcttcatggttcctgatgtgaaatacaatgaagcttacatttcatttctgttcgtccaccctgaatggagaagagcagggattgcaactttcatgatctatcatctgattcagacctgcatgggcaaggacgtaacccttcacgtctcagcaagcaaccctgctatgctactgtaccagaagtttggattcaagactgaagaatatgtattagatttctatgataaatattacccattggagagtacagagtgtaaacacgcattctttctgaggctccggcgctgatgcgaatacagctcacagagaaacgcatgtgctattggagaacaggtctttgtggagatctaaaggcagtgattgatttcacagggagctctaatctctgtgattacatggtccttcaaactcccaaccaaagtgagaaaagcggcatgcagtgaaatgagcagtgagcagccctttagcaaaatcgccctccagtccttcctggagatgccttcagccagcatcccagactccacagttatttatgaatgatgtcgtgattctccctccacctgacagtttgtaagagtgaaagagcatctaacctgatgctcttggagagagataacctgtctgtcataacttaaaggatgagaaaatgtggtgtagctattaaagattcatgcagtcccaaaaggcactgtcctgggatgatgagagattataaggtgatttcataaaaggaatccaaccctgtgcccggccattgatgtgttgtcattgaatccaggaggatttctagggcactgaagttttgttgtttcttttgctgactttggttacagtcagaaaaaataaactagatgtttgtgtctacatgttctacctgttgtacctattagcatcttcctgcagggacttgggcccatggcctgggaggttggtttgggattggggttgttgggcagcctgccattcacctggcctatcctggcccttctcatgcccaagacagttgtttcacaggagtggaagtgtgggtgatgcaagtagaaccctctagatgtaccctgtgtggtctgcaggactggactgtttgctgtgtttgtggatgttggcgatagactgtcaattaggttgtttgtgatccaacaagaacatttccaaaagtatctaggtgttctcaaataaaaagctttctttgcacaacccatggccagagcgtcaa

SEQ ID NO: 539 - DNA, 3698 bp, Homo sapiens
agttttgaaaatcatagttttcgcccgcgctgcgccgcctggttgctcctcccgtgcggtgagtcccgaaggcccggagccaagtgggtctgggcaagcggggccttacctagggataccaccggacttggatcggagcagccttcaggggacgtggcgcagtcgaacagagccaccatggggacgacggccccagggcccattcacctgctggagctatgtgaccagaagctcatggagtttctctgcaacatggataataaggacttggtgtggcttgaggaaatccaagaggaggccgagcgcatgttcaccagagaattcagcaaagagccagagctgatgcccaaaacaccttctcagaagaaccgacggaagaagagacggatttcttatgttcaggatgaaaacagagatcccatcaggagaaggttatcccgcagaaagtctcggagcagccagctgagctcccgacgcctccgcagcaaggacagtgtagagaagctggctacagtggtcggggagaacggctccgtcctgcggcgtgtgacccgtgctgcggctgcagctgccgcggctaccatggcattggctgcaccttcttcacccacccctgagtctcccacgatgctgactaagaagcccgaggataaccacacccagtgccagctggtgcctgtggtggagatcggcatcagtgagcgccagaatgctgagcagcatgtcacccagctcatgtccaccgagcctctgccccgcactctgtccccgactccagcttcagccacagctccaacctcccagggcatcccgacatcagatgaggaatcaacacctaagaagtcgaaggccaggatactggagtccatcacagtgagctccctgatggctacaccccaggaccccaagggtcaaggggtcgggacggggcggtctgcgtctaagctcaggattgcgcaggtctcccctggcccacgggactcgccagcctttccagattctccatggcgggagcgggtgctggctcccatcctgccggataacttctccacgcccacgggctctcgcacggactctcaatcggtgcggcacagcccgatcgccccgtcttccccgagtccccaagtcttagcccagaagtactctctggtggccaaacaggaaagtgttgtccgcagggcgagcagaaggcttgccaagaagactgccgaagagccagctgcctctggccgcatcatctgtcacagttacctggagaggctcctgaatgttgaggtgccccagaaagttggttctgagcagaaggaaccccccgaggaggctgagcctgtggcggcagctgagccagaggtccctgagaacaatggaaataactcgtggccccacaatgacacggagattgccaacagcacacccaacccgaagcctgcagccagcagcccggaaacaccctctgcagggcagcaagaggccaagacggaccaagcagatggacccagagagccaccgcagagtgccaggaggaagcgcagctacaagcaggccgtgagtgagctggacgaggagcagcacctggaggatgaggagctgcagccccccaggagcaagaccccttcctcaccctgcccagccagcaaggtggtacggcccctccggacctttctgcacacagtgcagaggaaccagatgctcatgaccccgacctcagccccacgcagcgtcatgaagtcctttattaagcgcaacactcccctgcgcatggaccccaaggagaaggagcggcagcgcctggagaatctgcggcggaaggaggaggccgagcagctgcgcaggcagaaggtggaggaggacaagcggcggcggctggaggaggtgaagctgaagcgtgaggaacgcctccgcaaggtgctgcaggcccgcgagcgggtggagcagatgaaggaggagaagaagaagcagattgagcagaagtttgctcagatcgacgagaagactgagaaggccaaggaggagcggctggcagaggagaaggccaagaaaaaggcggcggccaagaagatggaggaggtggaagcacgcaggaagcaggaagaggaggcacgtaggctcaggtggctgcagcaggaggaggaagagcggcggcaccaagagctgctgcagaagaagaaggaagaggagcaggagcggctgcggaaggcggccgaggctaagcggctggcagagcagcgggagcaggagcggcgggagcaggagcggcgcgagcaggagcggcgcgagcaggagcggcgggagcaggagcggcgcgagcaggagcgacagctggcagagcaggagcgtcggcgggagcaggagcggctccaggccgagagggagctgcaggagcgggagaaggccctgcggctgcagaaggagcagctgcagagggaactggaggagaagaagaagaaggaagagcagcagcgtctggctgagcggcagctgcaggaggagcaagagaagaaagccaaggaggcagcaggggccagcaaggccctgaatgtgactgtggacgtgcagtctccagcttgtacctcatatcagatgactccgcaagggcacagggcccctcccaagatcaacccagataactacgggatggatctgaatagcgacgactccaccgatgatgaggcccatccccggaagcccatccccacctgggcccgaggcaccccgctcagccaggctatcattcaccagtactaccacccaccgaaccttctggagctctttggaaccattctcccactggacttggaggatatcttcaagaagagcaagccccgctatcacaagcgcaccagctctgctgtctggaactcaccgcccctgcagggcgccagggtccccagcagcctggcctacagcctgaagaagcactgaggctggcctgcggccttcttggcagcctcgcctcctgtccatgtctatctgtctgtctgtcggtctctgtcttggtctgttgccctccttcttggcatgccattgtggagggcttggccaggtgtatataaacgtcctctgtgctgggtgtttctgctgcaggtggcaggtggccccaggcctgtttggaggatgggctgggtgggtgggtggggaagaaatgggcccagccccacatggcctgcagacagtgctctgtaaatagttgttttaatttagctgaatgttagcattttagtctttggcattttagcgtttgggaggtagattaataaagtatattccttcaagcctgctgttgataccatgaagactgggcgcctcagtcccagccctgtagctgtgtgtcttgggccaccagtggcctgcaggacgaaggtactgttccatcacctgcggtgtgcctcaggatcaccaggtgcaggcccccaccctcggagatgctgctgcagtgagtggttccactgcctggataacccttgaggaacacgtcagttactgtcacgatggggcaggtggagctccttcctattttttggggtgctccctgtttgtaaaggggagtttgttcattgggaaagacctgggtcttgacacggccctgccacttagtcccctaccctctccattccccaggctccacccgtgctgctcaggtgcaaatggacttgagagcatctatgtgctggtgaagcatgaggtctgagtagaaaagg

SEQ ID NO: 540 - DNA, 4969 bp, Homo sapiens
gcggtacgggggtggtgccgcgctcctggccccgcgcgggcggacggcggaggcgcctcccagcctgctatgggatggatgaagaagagaaccactatgtctcgcagctcagggaagtctacagcagctgcgacaccacggggactggctttctggaccgccaggagctgacccagctctgccttaagcttcacctggagcagcagctgcccgtcctcctgcagacgcttctcggaaacgaccatttcgccagggttaactttgaggaatttaaggaaggttttgtggctgtgttgtcttcaaatgctggtgttcgcccctcagatgaagacagtagttctttggaatcagctgcctccagtgccatccctccaaagtatgtgaatggttctaagtggtatggccgtcggagccggcctgagctatgtgacgctgccacagaagccagacgcgtgccggagcagcaaacccaggccagcctgaaaagtcacctctggcgctcagcgtctctggagagcgtggagagtcccaagtcagatgaagaggccgagagcactaaagaagctcagaatgaattatttgaagcacaaggacagctgcagacctgggattctgaggactttgggagcccccagaagtcctgcagcccctcctttgacaccccagagagccagatccggggcgtgtgggaagagctgggggtgggcagcagcggacacctgagcgagcaggagctggctgtggtctgccagagcgtcgggctccagggactcgagaaagaggaactcgaagacctgtttaacaaactggatcaagacggagacggcaaagtgagtcttgaggaattccagcttggcctcttcagtcatgagcccgcgctacttctagagtcttccactcgggttaaaccgagcaaggcttggtctcattaccaggtcccagaggagagcggctgccacaccaccacaacctcatccctcgtgtccctgtgctccagcctgcgcctcttctccagcattgacgatggttctggcttcgcttttcctgatcaggtcctggccatgtggacccaggaggggattcagaatggcagggagatcttgcagagcctggacttcagcgtggacgagaaggtgaaccttctggagctgacctgggcccttgacaacgagctcatgacagtggacagtgccgtccagcaggcagccctggcctgctaccaccaggagctgagctaccagcaagggcaggtggagcagctggcaagggagcgtgacaaggcaaggcaggacctggagagggccgagaagaggaacctggagtttgtgaaagagatggacgactgccactccaccctggagcagctcacggagaagaaaatcaagcatctggagcaggggtaccgggaaaggctgagcctcctgcggtctgaggtggaggcggagcgagagctgttctgggagcaggcccacaggcagagggccgcgctggagtgggacgtggggcgcctgcaggctgaggaggctggcctccgcgagaagctgaccctggccctgaaggaaaacagtcgcctacagaaggagattgtggaagtggtggaaaagctttcggattcggagaggctggccctgaagctgcagaaggacctggagtttgtgctgaaggacaagctggagccacagagtgcagagctcctggcccaggaggagcggttcgcagcagtcctgaaggaatacgagctcaagtgccgggacctgcaggaccgcaacgatgagctgcaagctgagctggaaggcctgtgggcgcggctgcccaagaaccggcacagcccctcatggagcccggatgggcgcagacggcagctccctggactcggcccagcaggcatttcattcctgggtaattctgctccagtgagtatagaaacggagctgatgatggagcaggtaaaggagcattaccaagacctcaggacccagctggagaccaaggtaaattactacgaaagggaaattgcggcactgaaaaggaactttgagaaggagaggaaggacatggagcaggctcgcaggcgcgaggtcagcgtgctggagggtcagaaggccgacctggaggagctccacgagaagtctcaggaggtcatctggggcctgcaggagcagctgcaggacacagcccgcggccccgagcctgagcagatgggcctggcaccctgctgcacccaggcactgtgtggcctggccctgcggcatcacagccacctgcagcagatcaggagagaggctgaggcggagctgagtggagagctgtcggggctgggagccctgcccgctcgcagagacctgaccttggagctggaggagccgccgcagggacccctgccacgcgggagccagaggtcggagcagctggagctggagagggcactgaagctgcagccctgtgcgagcgagaagcgcgcccagatgtgcgtatcgttggccctcgaggaggaggagttggagcttgcccgcgggaagcgagtggacgggccctccctggaagcagagatgcaggccctgccgaaagatgggctggtggcaggaagtggccaggagggcacacgtggcctcctaccactgcgtccgggctgtggggagcggccactggcctggctggccccaggtgatggcagagagtctgaggaggcggcaggagccgggcctcgccgcaggcaagcccaggacacagaagctacgcagagcccggcccccgcccctgccccggcatcccacggcccctcagagaggtggtcacgcatgcagccctgtggagtggatggggatattgtcccaaaggagccagagcctttcggcgcgagcgcagcggggctggagcagcctggagcccgggagctgcctctgctgggaacagagagagacgcctcgcaaacccagccacggatgtgggagccacccctgaggccggccgcttcgtgcaggggacaggctgagaggctacaggccattcaggaagagcgagcacgaagctggagcaggggcacccaggagcaggcctcggagcagcaggcccgggccgagggcgccctggagcctgggtgtcacaagcacagtgtggaggttgccaggagagggtccttgccatcccacctccagctcgcagacccgcagggttcctggcaggagcagcttgctgccccagaagagggggagaccaaaatagcgctggagagagagaaggatgacatggaaaccaaacttctacatctggaagacgtcgtccgggctctggagaaacatgtagatttgagagagaacgacagactggagttccatagactttctgaagaaaacactttgttgaaaaacgatctgggaagggttcggcaagagcttgaagctgcagaaagtactcacgatgcacagaggaaggaaattgaggttttaaagaaagacaaggaaaaggcctgctctgagatggaggtgctcaacagacagaatcagaactacaaggatcaattatcccagctcaatgtcagggttcttcaactgggacaggaggcttctacccaccaggcccaaaacgaggagcatcgtgtgaccattcagatgttaacacagagcctggaggaggtggttcgcagtgggcagcagcagagtgaccaaatccaaaaacttagagttgaacttgaatgcctgaatcaggaacatcagagcctgcagctgccatggtcagagctgacccagacccttgaggaaagtcaagaccaggtgcagggagctcacctgaggctgaggcaggcccaggcccagcacttgcaggaggtccggctggtgccccaggaccgtgtggccgagctgcatcgcctgctcagccttcagggagagcaggccaggaggcgcctggatgcacagcgggaagaacatgagaaacagctgaaagccacagaagagcgggtggaagaggcggagatgattctgaagaatatggaaatgctcctccaagagaaagtggataagctgaaggagcagtttgaaaagaacacgaagtccgacctgctgctgaaggagctgtacgtggagaacgcccacctggtgagagcacttcaggccaccgaggagaagcagcgaggcgccgagaaacaaagccgcctcttggaagaaaaagttcgcgctctcaacaaactcgtcagtaggattgcccccgcagccctctctgtgtaaagacagattattttctaggattcattcgaaagcacatcttttaaattaagccactgtgctgccttagattccgtgggtcatgagccatgagtcctgggacatctgaggattgggattctttgttcaccccgcagatagttaatgaatggtctgccctgggcaagatggaggtgggggctgggggaatatgcatgttgcagaagccggcgtttttattagcggtcctgagtaatttcccttggcaaaattcccagttttgccactctctggagccagatcctgggagctgtcagcaaggagcaggtaagtgagcagttatggacagcactttccatgtggtgcttccgaccctggctgtcagagtgaaatgtaaagtcagggctctgtacagttttgccatttcactgttctgctttaagcttagcttattagaactcttggtggagggtgcgtacacacattccagaaaaggcttcactcgctgggaacgtcaacccagcgagaaaggaggggaagccccttctccggggaccttatctgtggactcaggaatgatggtgtttattgcaaatgcacaatctttttcccattgaaatgtcatcacactggaaattgtactatatgtaaaaaaaaaaaaaagtatagttttatatttgaaatgtatgcaaattatggccatatggctgattggaatgtactactgtaatataaaaagtcactgtatttgcaataaattcttttctatt

SEQ ID NO: 541 - DNA, 5630 bp, Homo sapiens
ttgcgcgctgcagggcaacaccccggcgtccctggaagctgggggagcgggagaaataactttatttggactgagagctggagaatgagaataggacctgagagtatattgggctaaggaggagaggtgtttgagcccagatgagtcatggctggacgacccctccgcataggagatcagctggttctggaagaagattatgatgagacctacattcctagtgagcaagaaattcttgaatttgcccgggagattggtattgatcccatcaaggaaccagaactgatgtggctggcgcgagagggcatcgtggccccactgcctggagagtggaaaccatgccaggacatcacaggtgacatttactatttcaacttcgccaacgggcagtctatgtgggaccatccatgtgacgaacactatcggagcttggtgatccaagagcgggcaaagctgtcaacttctggggccattaagaagaagaaaaaaaaaaaggaaaagaaagacaagaaggacagagacccccccaaaagttcgctggccttgggttcctcattagccccagttcatgttcctcttgggggcctggctcctttacgaggtcttgtggataccccaccctctgctcttcgtggatctcaaagcgtgagcctggggagctcagtggagtctggacgtcagcttggagaactcatgctgccttcacagggtctcaagacctctgcttatacaaagggtctcttgggctccatatatgaggacaagactgctctcagcctcttgggtttaggagaagaaaccaatgaggaggatgaggaggaaagtgacaaccagagtgtccacagctcaagtgagcctcttaggaacctacacctggacattggggcactggggggtgactttgagtatgaggagtctctgagaacaagccagccagaggagaagaaggatgtttctctggattcagatgctgccggtccccctactccctgcaagccctccagcccaggtgcagacagcagtctgagcagtgctgttggcaaagggcgacagggaagtggagcaagacctggtcttccagaaaaagaggaaaatgagaagagtgaacctaagatttgcaggaatctggtgacccccaaggcagaccctacaggcagtgagcctgccaaagcctctgaaaaggaagcaccagaggacacagtagatgcaggagaggagggttccaggagggaagaggcagccaaggagccaaagaagaaggcttctgctctggaagagggcagttcagacgccagccaagaactggaaattagtgaacacatgaaggaaccacagctctcagactccatagcttctgaccccaagtccttccatggcctggacttcggttttcgcagccggatctcggagcacctgctggatgttgatgtgctttccccagtcctgggtggagcttgtcggcaggcccagcaaccactgggaatagaagacaaggatgacagccagtccagccaagatgagctgcagagcaagcagtccaaaggcctggaggagaggttatctcctccacttccacacgaggagcgggcccagagtccccctcgcagcctggccactgaagaagagcctccccagggccccgaggggcagcccgagtggaaggaggcagaggagcttggggaggactctgcagccagcctcagcctgcagctgtccctccagagggagcaggccccaagcccacctgctgcctgtgagaagggcaaggagcagcattcccaggccgaggagctgggccctgggcaggaagaggcagaggatcctgaggagaaggtggcggtcagccccaccccgccagtctctccagaggtgcgatccacagagcctgtggctcccccagagcagctctcagaggctgcactaaaggccatggaagaggcagtggcccaagtactcgagcaagaccagaggcacctgctggaatccaagcaagagaagatgcagcaactgcgggagaagctgtgccaagaggaggaagaggagatcctccggcttcaccagcagaaagagcaatctctcagttccttgagggagcggctgcagaaagccattgaggaggaggaggcccggatgagagaggaggaaagccagaggctatcctggctccgagctcaggtccagtccagcacacaagcagatgaggaccaaatcagggctgagcaagaggcttccctgcagaaactgagagaagagttggagtctcaacagaaggctgagagggccagcttggaacagaaaaataggcaaatgctggagcagctcaaggaagagatagaggcttcggagaagagcgagcaggctgccctgaatgctgcaaaggagaaggctctgcagcagctgagggagcagctggaaggggagaggaaagaagctgtggcaacgctggagaaggagcacagtgctgagctggagcggctctgctcctcattggaggccaagcaccgggaggtggtctccagcctccagaagaagatacaggaagctcaacagaaagaggaggcccagctgcagaagtgccttgggcaagtggagcacagagttcaccagaagtcttatcacgtggctgggtatgagcacgagctcagcagtctcctgcgagagaagcgccaggaagtggaaggggagcatgagaggaggttggacaagatgaaggaggagcaccagcaagtgatggctaaggccagagagcagtatgaagctgaggagaggaagcagcgggctgagcttctggggcacctgaccggagagctggagcgcctgcagagggcccatgaacgagaactggagactgtgaggcaggagcaacacaagcgtcttgaggacttgcggcgccggcacagggagcaggaaaggaagctccaggatttagagttggaccttgaaaccagagctaaagatgtcaaggccagattggctctgctggaggtccaggaggagaccgcccggagggagaagcagcagctgcttgatgtgcagaggcaggttgctctgaagagtgaggaagccacagccacccatcagcagctggaggaggcacagaaggagcacacccacctgttgcagtcaaaccagcagctccgagaaattcttgatgagctgcaggcccgcaagctgaagctggagtcccaagtggatctgctgcaggctcagagccagcaactgcagaaacacttcagcagcctggaggctgaagctcaaaagaagcagcacctgttgagagaagtgacagttgaggaaaataatgcttccccacattttgagccagatctccatattgaggacctgaggaaatcccttggaacaaaccagaccaaagaggtgtcttcttctctctcccagagcaaggaggacttatacttggacagcctgtcctcccacaatgtctggcacctcctctctgctgagggggtagccctccgtagtgccaaggagttccttgtgcagcagacacgctccatgcggaggcggcagacagctctgaaagctgcccagcagcattggcgccatgagctggccagtgcgcaggaggtggccaaagacccaccaggcatcaaggccctggaagatatgcgcaagaacctggagaaggagaccaggcacctggatgagatgaagtcggccatgcggaaaggccacaacctgctgaagaagaaagaggagaagctgaatcagttggagtcctctctttgggaagaggcctcagatgagggcactctgggaggatcccccaccaagaaggcagtaaccttcgacctcagtgacatggacagcctgagcagtgaaagttctgaatctttttccccgcctcaccgtgagtggtggcggcagcagaggatcgactcaaccccgagtctcacctcccgcaagatccacgggcttagccactccctccggcagatcagcagccagctgagcagtgtcctcagcatcctggacagcctcaaccctcagtcgccgccgccgctcctcgcctccatgccagcccagctccctccccgggaccctaagagcacccccacccccacctactatggctccctggccaggttctcagccttatcatctgctacacccacgtccacccaatgggcctgggattcagggcaggggcccaggctcccctcctctgtggctcaaacggtggacgacttcctgttggagaagtggcgcaagtattttccatctggcatcccgctgctcagcaacagccccaccccgctggagagcaggctgggttacatgtctgccagtgagcagctccggctcctacagcactcccattcgcaagtccctgaggcgggcagcaccacctttcagggcataattgaggccaaccggaggtggctggaacgtgtcaagaatgaccccaggttacctctcttctcgtcaacacccaagccaaaagctactttgagcctcctgcagctgggccttgatgagcacaacagagtgaaggtgtatcgcttctgaggccctgagcaggggcttggggcagcccagcctctcctccacccagaccaagtgcctgaggagctgcctgccttcttccatctgagaaagcaccctccttccccctttgacttgcaggagccaccagggaccagggggttgagtggaacagtaaagccacacattctgtgactatataacctatctcaggctaaaatgtgtggactcgtacgagctcttgtcattgacatggcaagctgatggcgtgcggtggctgcggggtatcagggccgggagccctttgggaggaagggaggcgttagaggagctgccttcggaggctcagggagtccctttggagctggttgtttccttggccctgcagcgcactgctcggggctcccaaggaggttgtgtgtatggttcttaattcatcaggacaaagacccccagcatgtgtgtaccctgggacccgatttctctgggcccacatctatctccaatacctcagcctcagatcagaccctttcttttttgtctttcttctcttaatttttaaatgcctcttttcttgagcattccatctctctttttgaccctctcaggactgggcttagctgtccagagccctgccggagggtgctgggggctgtccctctgcaggcactgtgttttcctcaggggctgtcctcagaacacccctcctgctccctggggctcctcagggagccatttcagctggagtctcaggtctcaaaaacaacttctccaggaggccaaaaaaagactgggttggcttctggtcctcatgatggcttttatcctcctgggacactttgggtatattcatgggcattgtttccatctgtcttttctacctgtgccacccctgccctgattccacggctgcctcaggcaggcaggcaaggagctaggccggtgcccggccctggcagcaaggggtctttgtgcagttggagatgctgccgttgtggcagagcgtcctgcagccccgcttccatcagcaggctctggggtgggggctttgcaggggatgctctctgatgtttgttccgttgtttaaataaaatgcacttatttttgtttttttttttgcaagc

SEQ ID NO: 542 - DNA, 2791 bp, Homo sapiens
agtctcgcgggaagctccgttgtgggcgccccggctggtggctgagctcaggccttcaggcagaggggaggcgagggcggggcggtcacgtgagagcactgccgcggtgggttgtgggggtgctgcggcgccgtttgctttgccaaaccgacaaaagagagatgatggccaacgacgccaagcccgacgtgaagaccgtgcaggtgctgcgggacacagccaaccgcctgcggatccattccatcagggccacgtgtgcctctggttctggccagctcacgtcgtgctgcagtgcagcggaggtcgtgtctgtcctcttcttccacacgatgaagtataaacagacagacccagaacacccggacaacgaccggttcatcctctccaggggacatgctgctcctatcctctatgctgcttgggtggaggtgggtgacatcagtgaatctgacttgctgaacctgaggaaacttcacagcgacttggagagacaccctaccccccgattgccgtttgttgacgtggcaacagggtccctaggtcagggattaggtactgcatgtggaatggcttatactggcaagtaccttgacaaggccagctaccgggtgttctgccttatgggagatggcgaatcctcagaaggctctgtgtgggaggcttttgcttttgcctcccactacaacttggacaatctcgtggcggtcttcgacgtgaaccgcttgggacaaagtggccctgcaccccttgagcatggcgcagacatctaccagaattgctgtgaagcctttggatggaatacttacttagtggatggccatgatgtggaggccttgtgccaagcattttggcaagcaagtcaagtgaagaacaagcctactgctatagttgccaagaccttcaaaggtcggggtattccaaatattgaggatgcagaaaattggcatggaaagccagtgccaaaagaaagagcagatgcaattgtcaaattaattgagagtcagatacagaccaatgagaatctcataccaaaatcgcctgtggaagactcacctcaaataagcatcacagatataaaaatgacctccccacctgcttacaaagttggtgacaagatagctactcagaaaacatatggtttggctctggctaaactgggccgtgcaaatgaaagagttattgttctgagtggtgacacgatgaactccaccttttctgagatattcaggaaagaacaccctgagcgtttcatagagtgtattattgctgaacaaaacatggtaagtgtggcactaggctgtgctacacgtggtcgaaccattgcttttgctggtgcttttgctgccttttttactagagcattcgatcagctccgaatgggagccatttctcaagccaatatcaaccttattggttcccactgtggggtatccactggagaagatggagtctcccagatggccctggaggatctagccatgttccgaagcattcccaattgtactgttttctatccaagtgatgccatctcgacagagcatgctatttatctagccgccaataccaagggaatgtgcttcattcgaaccagccaaccagaaactgcagttatttataccccacaagaaaattttgagattggccaggccaaggtggtccgccacggtgtcaatgataaagtcacagtaattggagctggagttactctccatgaagccttagaagctgctgaccatctttctcaacaaggtatttctgtccgtgtcatcgacccatttaccattaaacccctggatgccgccaccatcatctccagtgcaaaagccacaggcggccgagttatcacagtggaggatcactacagggaaggtggcattggagaagctgtttgtgcagctgtctccagggagcctgatatccttgttcatcaactggcagtgtcaggagtgcctcaacgtgggaaaactagtgaattgctggatatgtttggaatcagtaccagacacattatagcagccgtaacacttactttaatgaagtaaactaggcttatttctaaaaagtcaagtctattggctttggcccaaaagcactggtatctttgtattaaattcatgtttattgtcacaaaaccattatttatacctatacagttgtactgtttcttttaaagcaaagccatttaacatctttcttcattcctaatttggaaattaaagtttacctttctgttaatctatgtataaatgttactctgagttattaatgtggattttaaaattgtaagcaatagaataggaaataaaacaactacctaatacaaatatttctgataagactacaaatatctgactgagctggggattaaagtagaggtaactgtatcttaaatgagtatgatttccttgtaagttaaaaaaattgaaatttaattgtagacttcaatagtccaagttttgaaggatgtttgagcttttgtataatgccatttatacctgcagttttacagataatgtttgactgcagttgccttggaaattcctccaaagtttgccttcatctctcctctacagtttggaggtgatggtgcagcagtggaacatctcttgatgcaccacactacttgtgttctgtgaagtgatgaaagtataactggttctagtttgcacactacacacatagttttgtgaagcttcagaaatgttttttcttttccttgtggccaaaccagtttgttaatctgattatattcatctgctaatgatactaaagttaatgtaataaagcattt

SEQ ID NO: 543 - DNA, 2526 bp, Homo sapiens
acacctgccaagcatcacacctgccaagcatcacacctgccaagcatcacacctgcgatgcctgcacgagctgggtgcggtccgcgcagctgcagtaagggggcgacccggcgtctgttagtcggcggttcatctccttcgtgcctcgatgagctttaacgccattttcctccattctctttcttcacctcttgagtgagtggccatgagctgggctgcaagagtcctggggagcagccagagagcgggcgccgcgggagcgaattgtttttgcccaaggatggttctgtgtctccgccaggcggcatgtgacctgctcgggcgcgggtggcccttcacccctgtgagtgtggccagaagtacctctcacctggacctgcggaccccgggcgcagtcctggagctgagaactggaggttgggggaacagcagggtaaaggggagagaaaagggggtcagctgcgggacggagtgccgtcccagctgtagtttcatgtttggtggagcaacccctgttcctttcctctctctctctcttaattcctcttaactgtactcacgcttccttctccttcccctggtccgcttcatggatgctgagctgcctggccagaacctacccagcttctttgctggtcagatttgtcggtcttttgtgtgtctgcagcacctccttccacacgggcccaggagttctctatacgcgctctcaccgcaggtcttggaattccaagccatttccaattccaggtcttggaaatggctgtgcaatttgtcttcactgttaggtttccaagatggcaactatcaagagtgaacttattaagaatttcgcggaagaggaggccattcatcacaataagatctccattgtaggaactggatcggttggtgtggcttgtgctatcagcatcttattaaaaggtttgagtgatgaacttgtccttgtggatgttgatgaaggcaaactgaagggtgagacaatggatcttcaacatggcagcccttttatgaaaatgccaaatattgtctccagcaaagattacctggtcactgcaaactccaatctagtgattatcacagcaggtgcacgccagaaaaaaggagaaacacgccttgatttagtccagcgaaatgtatccatctttaaattaatgattcccaatattacccagtacagtcctcactgcaaactgcttattgttactaatccagtggatatcttaacttatgtagcctggaagttgagtggatttcccaaaaaccgtgttattggaagtggttgtaatctggactctgctcgttttcgttactttattgggcaaaggcttggcatccactctgaaagctgtcatgggctgatccttggagagcatggcgactcaagtgttcctgtgtggagtggtgtgaacattgctggcgtccctctgaaggatctgaacccagatataggaactgataaagatcctgagcagtgggaaaatgtccacaaaaaagtgatttccagtggctatgagatggtcaaaatgaaaggttatacttcttggggcattagcctatctgtagctgatttaacagaaagtattttgaagaatcttaggagagtgcatccagtttctaccctaagtaagggcctctatggaataaatgaagacatattccttagtgtcccatgtatcctgggagagaatggtatcacagacctcataaaagtaaaactgactcttgaagaggaggcctgcttgcaaaagagtgcagaaacactttgggaaattcagaaggagctcaagctttaaagttgcttaaagctaattctgtagattgaagatgaaatagtagttatggaattgtatatgtcaaacttttgaataaatttgaatttctaaaagttggaaaaatagaggaaagagtgacctatttagtatagccttccagcttttttttttttcttttttgggagggtctcattctgtcacccaggctggagtgcagtggcacaatcatggctcactgcaaccttgacctcccgagctcaggtgagcctcccacttcagcctccagagtaggtgggaccacatgcgtgtgcctccatgcctgcctaatttttgtatctttttgtagagatggggttttgccatgtcatccaagctggttttgaactcccaaagtgctgagattacaggggtgagccactgtgcctggccttagctttgatttagtatccagatgatagatgacacttttttttttttttttttaaagtgacggcatcaaagatgtttttggtacttctcagtacttgccttgtatgtatacgtaattgccatctggtccacaagaatgtgtttactgtgttacacaaatcctgattcttttcatcaggtgcatagtaattcttctctatggcttaatacctatgttcatttacatgctatctctacaatgtaaaaataaaagtgtatatatatacacacacacacagagagtaatctaaatgttcctaacactagataaaacattgatttg

SEQ ID NO: 544 - DNA, 2226 bp, Homo sapiens
gcaaatagacccaggcttgactggcaattaaacatgaaacttctcattgggtattttcgagactactacggggaatcagctaccagcttactgccatgtggagaactgcacgagattccgggattggaatcaaaatgctaatttaaaaggtcaagtgaagctgctcctcacgttttggcgtgcctgcgctctctgcaggcagaagcgaacaaagacccagcaagagaaggcagaggctaagacccatcccgtatctgctctcctgaaataattctggagtcatgcctgaaatgccagaggacatggagcaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggatccatcaattaagggaacctttcactggtctggcaatgaacagatgactaagtatgaaatggcatgtgcaattgcagatgccttcaacctccccagcagtcacttaagacctattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaattaacacttgatccagaa

SEQ ID NO: 545 - DNA, 4461 bp, Homo sapiens
gtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgatttgtgtacatcaatggcagaatcatccagcgaatcagatcacttccgctgtcgtgaccgattgagtccatgggctgccagatcaacgcacaggggaactcgaagtcttcctacagtagaagttaccgagaaggtcaacactataacaagtactttacaggataccagtcggaacctgcgacaagtggaccagatgcttggacgataccgagaatacagtaatggacaggcgggtgcgatagaacatttaaaagaaagcttggaacaatcaatcgaccaactccggagtcaacgtttattgagaaactcaggagggagaagtatttctgttacaagtttgagtgcaagtgaccttgatggtggcactgggtcagagctccatcattttccacctacctcacctctcaaggactatggggatccacagggtattaaacgaatgagatcaagaactggtgtccggtttgttcaagagactgatgatatgactcagcttcatggttttcatcagtctcttcgagacctcagcagtgaacaaattcgccttggagatgatttcaacagggagctttccagaaggagccggtcagatgccgaaacaaaaagggctttggaagaattgactgaaaaacttaatgaagcccagaaacaagaagtggtttcagatcgggtggagcggcggcttcaggaactggagagagagatgcgcacagaaagggagctggtggaaagacgccaggatcaactgggactcatgtccctgcagctacaggaggcactaaagaaacaagaagctaaagcagatgagcatgagggggcaataaaaaataagctaagacaaactgaaactgagaagaatcaacttgaacaggaattggagctatctcgaaggttattgaatcaatcagaaggcagccgagaaacacttttgcatcaggtagaagaactgcgtacacaacttacgaaagcagaaggtgatcgaaagggtttacagcatcaagtatctcagatttccaagcaacagtcaaactatcaggatgaacaaggggaggactggagatttaggagaggggttgagcgggaaaaacaggacctggagaagcaaatgtcagatttgagagtgcagctgaacttcagcgcaatggcatctgagttagaggaagtgaaacggtgcatggagagaaaagacaaggagaaagcacatttggcatcacaagtagagaatttaacacgtgaactggagaatggggaaaaacagcaactgcagatgttggatcgacttaaggagatccagaatcactttgacacatgtgaggccgagcgtaagcatgctgaccttcagatctcagagctgactcgccatgcggaggatgcaaccaagcaggctgagcggtacctcagtgagctccagcagtcagaggctctgaaagaggaggcggagaagaggagggaagacctgaaactgaaagctcaagaatccattaggcagtggaagcttaagcataagaagttagaacgagcgttggagaaacaatctgaaactgttgatgaactgacaggcaagaataatcagattttaaaagaaaaggatgaattgaaaacccagctgtatgcagcattacaacaaatagagaatcttcgaaaggaattgaatgatgtcctaacaaagcgtgcccttcaggaggaggagcttcactccaaggaggagaaattacgtgatattaagtctcatcaagctgaccttgaattggaagttaagaattccctggataccatccatagactggagagcgaattgaaaaagcagagtaagatccaaagccagatgaaagttgagaaagctcacttggaggaagaaattgcagagctcaagaagagccaggcccaggacaaagctaaacttcttgagatgcaagagtccatcaaggacctgagtgccatccgagcagatcttgctaataaattggctgaggaagagagagccaagaaagcagtgcttaaggacctttctgacctcactgcacaggcaaaatccagggatgaagaaacagctacaatcatcacacagttaaagctggaacgagatgtgcaccagagggagctgaaagatctcacatcatcattgcagagtgtgaaaacaaaacacgaacagaatatccaggagcttatgaagcactttaagaaagaaaagagtgaggctgagaatcatatcaggactctgaaggctgaaagtttagaagagaagaatatggctaaaattcatcgtggtcagctggagaagttgaaatcacagtgtgacagactgacagaggaattaacccagaatgaaaatgagaacaaaaaactgaagctaaaatatcaatgtttgaaggatcaactagaagaaagggaaaaacatataagcattgaagaggagcacttaaggaggatggaagaggccagattgcagctcaaggatcaacttctttgcttggagactgaacaggaatccattcttggtgtgataggaaaggaaattgatgcagcttgtaaaacattctccaaggactcagtggagaaattaaaagttttttcatctggtcctgatatacattatgacccacatcgctggttagcagaaagcaagactaaacttcagtggctctgtgaggaactgaaagagagagaaaacagagagaaaaatctgcgacaccagctgatgctctgcagacaacaactcaggaatttgactgaaaacaaggaatctgagttgcagtgtctctttcaacagatagaaaggcaggagcagcttctggatgaaatacatcgtgagaagagagatctactggaagagacccaaagaaaagatgaagaaatgggatctctgcaggaccgtgtaattgcattagaaacgagtacccaagtggccttggaccatctggagtctgtgcctgagaaactgagcctactagaagatttcaaagacttcagagattcctgcagttcatctgagagaactgatggaagatattccaaatacagggttcgcagaaattctcttcagcatcaccaagatgacaccaagtacagaaccaaaagtttcaaaggtgacagaacctttctggaaggttcccacactcgtgggttagatcactcatcctcttggcaggatcacagtcgcttcctgtctagtccaagattttcatacgtgaactcatttaccaaaagaactgttgctccagattcagcttcaaacaaggaagatgccacaatgaatggaacaagttcacaacccaaaaaagaggaatatgggagctaaaaaagcaaatgtaatttgttattttacatgagtatgttacaaataataacatctctattcttacagcaatttggcccagattatctaacagacatacctgcagctttggctctttggtattgccaaacattgacaaaagtgacaatactgttggtccttgtgaatggtaaaccaatccaaataatatcagatcatgaatgatgtgcagctaatttatttgcaacttatactagcacagaaagaatgatattttttcactttgtattttcctttttcaagtgtggtcagtcacattttcccaaccaaaatttggatttctaattgaggccttttaaaaattactggctaaaaagaaggaaaatgagtttcccttgaggcaaaagttgccagcactttagattcagggagcatttatatacaactgattttttgaaaaattttctccctaataaattatcatgtgttataacatgtggagatgtgcatatataacattagacagtccactttataaatgctcaggacttttatatctatcatcttaacagtccacaactgcataccgtagctgaaaattatttccaatcatccatttttaatagcaataaagaattcataaatgatatctgaactgtagagcactgtaaagaattcatagcacaatttatttatttgtctttttgtggccaaatatcctactgtgatcacttcagtcatatcctggaccgtctttggtttactgtgactaaaatcatagcaccaaactcctttgtccatgagatttatatataatcttgtataatttggtcctatctgcttctaccatcccaacttttttcatcaaagtgtctaagaacgtattccctttacacgctgatctcctagtggagaaggatttatattaaatgctaagtaatagtaaactttcaggaactgaatcctattgggtcatggattctgcatagacaagggcaataaagcaatacctttgtaatatgcattaca

SEQ ID NO: 546 - DNA, 1542 bp, Homo sapiens
tgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaagctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactggggaggacgctcacaagctaatagacttccttaagctgaagagaaatcagcaggaggacgactgatgagcgtactggaactggagaagaggaggccccgccccaccgctccgggagctgctcatcagccgcaacttcctgccgaccctgatgcgggtgggccgagcagtgtggacatcagccactttttatattcatgtacattcacctggggaaaaaaacggagggactttgctacttgtaaaaataacataataaatagatcttaaacataggaaaaccatactgttctgataataaaatgctttctatgaaat

SEQ ID NO: 547 - DNA, 4023 bp, Homo sapiens
agtactccctgattggctctgcactggaggcagtgattttggggcagagaattttgcaacacgtggtagtgaactgtgaggagtttgaggggtctgaagactgaaagagtcgaatggtttgttggcagggtgtcctggtggattggtttctgtaagttcagattctcataaatcgtgtgagcgtcgccgacacctctgagataaaagggcccctttcgactagcctctgctgaaaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctagcagaacatcatgaagtcttgacagaatataaagaaggagttggaaagtttataggcatgccagaatcactcttgtactgctccctgcacgatccagtcagcccctgcccggctggttatgtaacaaacaagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggctcatatctggtgttagtcggccagatgaggtgctcgagtgtattgaaagaggagtggacttatttgagagttttttcccttatcaagtaacagagcggggatgtgccctgactttcagttttgattaccagccgaatcctgaagagacactactacaacaaaatggaacacaagaagaaataaaatgtatggatcaaataaagaaaattgaaacaactggttgcaaccaagaaataacatcatttgaaattaatctgaaggaaaaaaagtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactgttgtaacatgggaagacgtgaagaagaaataatctgagctttaattatttatatttggatataaggtctgcttaaataaagaatctttgtaccaaactgcccacatgagggtgaagagatttcctcaaaagacttaaatgacctggattgatcagagagaattgaactgtgacctttaagacttctagactaattcttttagttgatagagattcatttagtcaaagacaaaagctttaactgtgagggcacagccttgaagtgggagtgatgagattctgagggacccatgaattggattgaggcttgaggggaaatggtgtgagacgaatgggctctggacatatgcctgttgatttgagaagaaatctggctggtttgagggtttcctttagttcaccctcatactctcaggagactcttctggatacttttgtcttccaccctgccctggcagtgcagccaatcagaaatggctcttgtgacttaactgggcttggatatccctggaatgtggggcttgaacattgctcctgtgatgatcatctgtcccaggtcacactccttcatttgaccacatggcctatttgcaacttctttttagagccaatgtaattgcctgttaggagccagaagtttgcccagctgctttcttctggttgtacagatccattgtggtctgccttccaggctcattaatagtctaactacgtaataactgaagacctatctcttgtgaagattcattctcaatgtgttcacttggacagagccctgcctggcctaacgattagagggttagtctccatcctgctcagatatgactcctgggcaattcacttaacttctccatggctgcttcctgctgaataaatagggacaggcataatggataggaatgaatgaacttttaagatactgtctagctctaaaattggaagaacaaaaagttttagattagagtcatagccttaatagccctagttgtcatcctgggagacaggcaacagtagagatatttgagagcctaaagagaggtttggcctgtgggtttttaagtggttattgaattggtatcaggagatcctgaggctggtaggggaaggtaattctttctaagttacctctgtatttttcaagttttctataaggaatacacatacacccacatgcacacaccatagtttttatacaaacagcaataacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggtaatttggttttttggttttttggggttttttttgagacggagccttgctctgtcgcccaggctggagtgcagtggcgcgatctcggctctatgcaacctccacctcctgggttcatgccattctcctgcctcagcctcccgagtagctgggactacaggcgcccgccaccatgcctggctaattttttatatttttagtagagatggggtttcaccgtatgagccaggatggtctcgatctcctgacctcatgatccacaagactgggtaatctgtaaagaaaagaggtttaattggctcatggctctgcaggctttacaggaagcatggtactggcatctgcttggtttctggggaggcctccggaagcttatagtcatgacagaaggtgaagggggagcaggcacatcacatgacaaaagcaggaacaagactcagagcaagaagtcacttatcaccaaggggatggcccaggccattcatgagggatccacctttgtgctccaaacacctcccaccaggccccacctccagtattggggattacatttcaacttgaggtttgggcgggaacaaatagtcaaattatattacccatctacatggttttctttttcttagtatgggagtgtccatgaataaattcatgggcatcctcataactcttccatgaatggcaaggggtacttatggaaaacagttttccaaagatctgattgttttgaaatgtgttagattggacttgttcaaatgttcatatttttgttctatgctaaatgcatcgttaggggagtagtggtaaatattccagaatccatatgaaattcatgagtttatttatgtctaaaacactgaaaactgtgtccaatatcgttcagtttcctgggtctttttcttattagcacatttgagaaaaatattcctttcctttattgtagtaaatctattaaaggcaatagccaataaaacatttttaattttaaaaatttactgtgtttggctttctgtaaatgtagtaggtctgttaaacaaaatattaaatttccatagtaccagaaa

SEQ ID NO: 548 - DNA, 3369 bp, Homo sapiens
acattacaatgcctgacaaatcctagccagttctatcaaattatatctttcttacaggcttttaagctattagtctcataaagatacatttaatcagcgaggtaatggcatgatgagtgtttttaggttaaaaagagaacaggaactgttgccagcagaatggcgatattcaagacaacacgcacaagaagaggcgggtcctacgcgcttcgctagggaagcccgggtcagctcgctgcgcaggcgcagtgagttcgacacaccatgccgactgtcagcgtgaagcgtgatctgctcttccaagccctgggccgcacctacactgacgaagaatttgatgaactatgttttgaatttggtctggagcttgatgaaattacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggataaaggctccagtgtataaacgggtaatgcctgatggaaaaatccagaaattgattatcacagaagagacagctaagatacgtccttttgcggtagcagcagttctccgtaatataaagtttactaaagatcgatatgacagcttcattgaacttcaggagaaattacatcagaatatttgcaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagaccatagcagcaaatcgtaagatgccccttccactgaaactgtttgaaatctctgacattgtaataaaagattctaatacagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatgttggaccctttttgtgaagattggtctctgtggtgtgattctcttcccaggtgtccctttctcctcccctagtgtccttaagtcctcctccacagggaacatctatttgggctttgatgtttaataaagtagaaagcactgtctggctgtgtgggtagagaccatcctttccctgcatattaggccagcttgtgccatataccagtgtggtgtctgtgtgtgaagctgcattgttgggtaaaagccccgtggagtgctggagaaatgcactagcagagtgcaggatctgttctgaaaggcagacgtgctcctcagacatcagaacatcacattggaacggattactcctgcataacaagatcccatttctttccttattgataaaacaagataatcgatgagaattcatgttgcatgagttcgagataactgaggggtttagctttgattttctacatttgacatgtattcatcattgagaaacactaaaataacaatatttttagaaaacgtttaagaatcaattatggtccaacaattatagcttctgaggtcagtttaaagtgaaagaaaaatctgtaatacaaggattcaaaatatgtgagggtgcataggtattttttactctatctgtgatactctaagatagagtacatgcaacaaagatctgttctgctgtaagagttaaaatggacaagtattgatatcaatgcagtatgaacattaggaaacaatgagaagcttatttttgccataggccatacatgttactgtaatcagtcagttataaaatcatggttttaaatacttaattgagctactagtttctctattgtcccagggagatattagacctctctttttctgaagctaagcttcagccaatcctccttgttttatatcctaatttcctttcttacttcaatctagaattctccagtaggtaccatctctggaaaaaagctgggtctcatgtttgagacaagttcccaggtactattgaagtaataagaaatatgataaaatataatactttaaagtcccagtagaaatagctaacaaaggctgggtgcgctgtggctcatgcctgtaatcctagcactttgggaggctgaggtgggcagatcacttgaggccaatagttcgagatcagcctgaccaacatggtgaaatgccatctccactaaaaatataaaaattagccaggcatggtggtgtgggcctgcagtcccagctacctgggaggctgagtcaggaaaatctcttgaaccaggaggtggacgttgcagtgatcccagattgtgccactgccctccagcctgggtgacagagtgagattctgtctacaaaaa

SEQ ID NO: 549 - DNA, 933 bp, Homo sapiens
tttcttgaaagaggcatttaccgagcgcccaatgtatgcctggcactgggctgggtgctgccacctaagcgagcacgaccaatgcagtctatcagggaggcccagatcgccaagcagcggacccctgcggtccgccatgccactcccggctcctagagcgccgctcagcacaccgtgagcgcccaataactgttgggcttcaatgacgccgcggaggcggccccgtccccgcgctcccgcccctcccgccagggcagcccgggaggccagacgttgacgctgcagggagagggtggtgggcgcagccgctagggggcgcggcggggcggagcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtca

SEQ ID NO: 550 - DNA, 1354 bp, Homo sapiens
aagtgcactaggtttgaaatcggaaagttggcggggctgcgggagctgagcctagagtccggctgttggctagagtgggcgcggatctggtgtggggaaggcggcgggactcaggcctgcctgcgaagcattgtcctacataatggtagaggacgaactggcacttttcgataaaagcataaatgaattttggaataaattcaaaagtacggacacctcctgtcagatggcgggactaagagatacctacaaggattccatcaaagcatttgcagaaaagctgtctgtgaaattaaaggaagaagaacgaatggttgagatgtttctggaatatcaaaatcagatcagcaggcaaaataagctcattcaagaaaaaaaggataacttgttaaaattgattgctgaagtaaaaggcaaaaagcaggaattggaagtactgactgcaaatatccaggatcttaaggaagaatattctaggaagaaggaaactatttctactgctaataaagcgaatgcagagaggttgaaaaggctgcagaaatctgcagacttgtataaagatcgacttggactagaaattcgaaaaatttatggtgagaaattgcagtttattttcactaatattgaccctaagaatcctgagagcccatttatgttttccttacatctcaatgaagcaagggactatgaagtgtcagatagtgcccctcatcttgagggcctagcagaatttcaagagaatgtaaggaagaccaacaatttttcagcttttcttgccaatgttcggaaagcttttactgccacggtttataattaacatacaaatagtgtatataaaaacggtttatttttcttctctattacatatctctttttttcttgtttttattattattatactttaagttttagggtacatgtgcacaatgtgcaggtttgttacatatgtatacatgtgccatattggtgtgctgcacccattaactcgtcatttcattaggtatatctcctaatgctatccctcccccctcccccaacccacaacagtccccgttgtgtgatgttccccttcctgtgtccatgtgttctcattgttcaattcccacctaggagtgagaatatgtggtgtttggttttttgtcctttcgatagtttgctgagaatgatggtttccagcttcatccatgttcctacaaaggacatgaactcatccttttttatggctgcatagtattccatggtgtatatgtgccacattttcttaatccagtctatcattgttggacatttgggttggttccaagtctttgctattgtgaatagtgccgaaataaacatacgtgtgcatgtgtct

SEQ ID NO: 551 - DNA, 4544 bp, Homo sapiens
atgaaactgactgattcgactaaaggatggatagtttgggcagcgttggacagctctatgaggggaatgtcgttgtctgctgggtcttcccctcttcattcccccaagattactccacatacttctcctgctcccagaagaagaagtcacactccaaatccagcaagttacatggtgccttctagtgcctctacatctgttaataatcctgtttctcagactccgtcttctggtcaggtgatccaaaaggaaactgttggtgggacgacttacttctatacagacacaactccagcacctttgactggaatggtgtttccaaactatcatatttatcctccaactgcacctcacgttgcttatatgcaaccgaaagcaaacgcaccttccttcttcatggctgatgaactccgacaggagctgatcaacagacatttaataacaatggctcaaattgatcaagcagatatgccagcagttcctacagaggttgacagctaccatagcctattccctctagaaccactgccacctcccaaccggatacagaaatcaagtaattttggatatattacatcttgctacaaagctgtaaacagcaaagatgatctgccatattgccttcggaggatacatggttttcgtcttgttaacacaaagtgcatggtgttggtcgacatgtggaagaaaattcaacactcaaatatcgtaactttgcgtgaagtatttaccactaaagcatttgctgagccctctcttgtgtttgcatatgatttccatgctggaggagaaactatgatgagcagacactttaatgaccctaatgctgatgcctacttcaccaagagaaagtggggtcagcacgagggaccattgcccaggcagcatgctggattattgccagaatctcttatttgggcatatattgtccaactaagttctgcattgcgtaccattcatacagcaggtttggcatgtcgagttatggatccaacaaagattctgataactggcaaaacaaggttgcgagtaaattgtgttggagtttttgatgttttaacatttgataacagtcaaaataataatccattggcattaatggcccagtaccagcaagcagatctgatatcattaggaaaagttgtgttggctttggcttgcaactctttggcaggaattcagcgagagaatttacagaaagccatggaactggtgacaatcaactattcctctgacctgaagaatctgattttgtatttgttgactgaccaaaacaggatgcgaagtgtaaatgacatcatgcccatgattggtgctcgattttatactcaattggatgctgctcaaatgagaaatgatgtcatagaggaagaccttgcaaaggaggttcaaaatggaagactgtttaggctcctagcaaaattgggaacaatcaatgagaggccggagtttcagaaggatcccacttggtcagagactggagaccgttatctgttgaaactctttagggatcatctttttcatcaggtgacagaagcaggtgctccctggattgacctcagtcatataatttcttgtcttaacaagctagatgctggtgtgccagaaaaaataagcctgatttccagagatgagaagagtgtacttgtggtgacctacagtgacttaaagcgctgctttgaaaatacttttcaagaactgattgcagctgcaaatggtcagttgtagtatttgctaaaaaagcacgcaggacatggctaaagaccttaaccaatagcaaattgcactacagctgaacttttcatcatctcattcacatttgggaaacgaacaggagatgagcaaagctgcttgcacttcagtcaggtacactgttacttgaaaggaagaatgtttcacttacccaagagctatggctgccattggaggctgttatctgtgaagaatttattttagatttaggagcaccatcaggtgaatgatgttcctgcttttgttttttccacttgtatatgcactaattttaattttttaaagactttttctgatctttgaacttttgccacattgtatacttataatgggaaactttgcaaggacatttttgggaagcaatgctgggcagcgtttttgccattgagggttgcagaatttgctctttttgggatgggttgccctgaataacattacggaccaggtaaataatttcatagaagttcagtatagtacgtaattcttgtaagagtatcgtatgcaagctctctgtatgccacccactgttagttcaaattgagatttttgttttgttttgttcttaagaacataccaagaaaataccagtgaattgttggatatgaattccctgttagttgatttaaatcctttctgaataaagatcagataaacagtaactgaaggagcatgtatagctctttccttcaaattcaactagagcctttttaaaaagacatttgcctgctagtcagatacatttacatttatgcaaattttttaaataggagaaaattaagaaattgtgttaaaggcctaaagttcaggagtgtattactttaggttctttccagtttgctggtttttttttttttttttttttttttttttgggcgggggggaggtttatgaagttttgctctttgaaccacagctttattatggtcctttacactggagacagacacagagacactgttcagaagatgaactaaactcagcagtggtctggtatcaagagctttctgatgttttacagcctgaatttggagggataacgatctgctgtgcctttgcagtcactgcttagcccaaagtaatagtacttttgataataactcactctgtgcgatattcctgaataagtccatctcaaaagtttgggattttcctcctcttaactttcttaatatttggacatgcagttgtcgccaaacttgggtattcatggaatttctagtaaatgaaatacctatactttgatactgaagactgccaaatacataggaattttctttcttaaaaaacagtaatgaagactatatctcctttcccagcactgaatgttttactagcactgggtgctcaccatgcaactgaagaaaatgtggaaactcaaaaggtcaggacagacttccaagcacttgcaactgatgttactgtcttcaattttaataattacacatatttgtatatttcagagaagtttttaatatttctctgtccactttttataagctttaaaatgattttctctgccttgagatttgcatcaagaaaaagcacctctcttcacctgaaagctttgaagactagagacacgctttacacgttttaacaagtatattgagtccacgtttggtagcatcagttgttgagttaaaaagaaaattattgcatttgatctggatggattttaaaagaatataatgttcaatattaaaaggataattcacatttgccaccataatgttcttttttatgtaaaaagaagaacttggagacattaacatgaaaaagtcttttatcattagctcatgtatttgaggaagagcagctgtctttttatatgttttttgacaaatcatattgtattcttttgtacaaaaaagaactacttgtattctagaagaaatatgaaatgcttaatttataagcgggctggagattttttccaatattgttttctttgaaaatgaaaggggatcatctattttagttttggggtctgggaactttttgaaaatttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttcagcccctagttaacctcaggacttggtttgcatataaaaggtagacagctgatatgttttcatgaataaatattgtcagccagaaaaggttggtgtcaggtaatgcatatttttttaagctttgttttatatttatttttcatttagtttttattgggaatggttttcaaagaactctcagttctgcctaggtgtttttgggggagccctgttttccatagtgtaattccatttaagaggttgtctaaaagtctttttaattaatagaaagattttaatatccaagagtagtcaaattaaggatataaactttccacaccttcctgtcgtgacagataaaagcacagaaaggacaacccttgaaatcatgtaacgttggtcatttcaatattttgtacctgttttaaattctgttagtgtatttacttcattgtaaatatttttgagggtacctttgtattttgcttttgaccttggttctgtgatttggatgtcaacaacttccctaaaaagcaccagtgtgttaggttctaatgtcatgacccaatttgtgttattcatctttaatcctgttttcagtctctatgtgtacagcagtatttttaataaagaattacagagataaattt

SEQ ID NO: 552 - DNA, 2135 bp, Homo sapiens
tttgatatgacgattagagcataacccgagtgacacgttgaattcgccataatcaaggaaaccttttccgggtggggatctctgaaattactcagataacagtgctgtgccaaaaacctgtggattttctctacaaaaattattgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagagaaatttacatgaatgtacctgtaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagt

SEQ ID NO: 553 - DNA, 1718 bp, Homo sapiens
aagctgcttccagtgaatgctacacacctgcaccatggtttgtccgacatccttagccaagatcaggattggctatgttggtacttacatatcctcatgagaattgtggttctggtactagtttggtaaagaaattattaaacctagctgatgcttgaaggtagttggattaacagaagagaagacaaacttggagtatattctttagtacatttttccccaaagatgttgggttcagttgccacaacactgccattgtcatcttcaaattccagtggaatgcctcttggttactatctgtctagtcctcagattagtagagtaactatatcaacaactggacaattgacttctaaagctactgtaggtagctgttccagagtggaaaacagcttggatgccagccccttctcagttccgaagaaacaggatgaatcacccatgattggggatggagaagattatttcctttctttgtttggtgattcaaagaaacttacagcacactcaaactacactcagaaaactttaaaatacttttctatgattcttgaagaagttggccaatttacctccagttctcttggagatgttgaaatagctgaagtgaatgtcaagggtttgttcgtgaagctcattaactcttcccttgacaaagaaatggcaattggagatcatattctccagcaaaatgtgaatggacaaaccatttctttgtaccgattccttccaaacatcgtaatgcaggcaaattccacagtaacagtgtgggcagcagcatctgaagcaaagcatcaacctccatcagattttctttggaaggaacaagacaagtttagagcaagtcctgattgtataacaatcctgtgcaaaccgaacggtcaagccattgcgtggtacacccctatccactggaagcaagcgtgggaaaaattagatgctgacgttgaatttaacagatgttcagtagtatctccaacattccgaaagcgtgtgtttcagtggacagcatctacagctacaataactaaagaaaaacaagatcaacctaagaaagatatctcaaattatcaggtggaacaagctcaagttcttcttaagagagagaaggaaatcccaccaaccgttttccctaatcgcagcccttggtgccagaatccctatgtctctgcacatccttactgtcctctgattgaaccacacaatacatccaccgctggaggcagattggatagacagcccaggactcggtcaaccagacctaatcgagcctcagggtctaagaaaaagaagacatctgagtcacaaaagcaataagcagtcaactcaacctttaaagtaatctagtccaccctcaaccagctactagaaaagcaaaagagaactcaaatccctgaggcctgctctgcaacctccctgctattccatgagagggtgaagacatcacatttctatatggaaaaaggatccaaaatttgtattgctgtagaattggtgaattatagatgcttgatgaaatcacaagtcctaccactcctgccttccaaatccctgcagaaaacaagcagatggttagtattattcaatggataaaattgctatttgccttagatttctctttttgtaaacaaagttattttgggtacagaactcacaaaagaagagcacgtgcaattgtttaaccattttacattgactgataaatctcttttttccat

SEQ ID NO: 554 - DNA, 1389 bp, Homo sapiens
tttcccggcgtccatttagtggcgggaaaagcgaccttttctgagcgcgtttgcctgttgagtggtagcctttcccctcaaccagcaatggaggagcagccccagatgcaagacgccgacgagcccgcggactccggaggggaaggccgggcaggcgggccaccgcaggtcgccggcgcccaggcggcgtgcagcgaggaccgcatgaccctgctcctcaggctgagagcacagacaaaacaacaactcttagaatataaatcaatggttgatgcaagtgaagaaaaaactccagaacaaattatgcaagaaaagcaaatcgaagctaaaattgaagacctggaaaatgaaattgaagaggtaaaagttgcttttgagataaaaaagcttgcattagacaggatgagactttcaactgcacttaaaaaaaacctggagaaaattagcagacagtctagtgtgctcatggataacatgaaacacctattagagctaaataaattaataatgaaatcacagcaggaatcttgggatttagaggaaaaactgcttgatattagaaagaagagattgcaattaaaacaagcttcagaaagtaagcttttagaaatacagactgaaaagaacaaacagaagattgatttggacagtatggaaaactcagagaggataaagatcatacgacaaaacctacagatggagataaaaattactactgttattcaacatgtgttccagaaccttattttggggagtaaagtcaattgggcagaggatcctgcccttaaggaaattgttctgcagcttgagaagaatgttgacatgatgtaataagaattcatttctgacatattttacatttctggcaatctcaactcttatttggaatacttctgtgcatttgtctgtccaccgtaattttagaaaagcatatccataacgtttacagttgtagtacagttgtggttagttatttgtagtgggattgaaagtaatttttttctttttatatttctatatttagtttgtttttttgttgttgttgttttttgagatggagtctcgctttgttgcccagactggagggcagtggcgcgatctcggctcactgcaacctctgcctcccgggttcaagcagttctgcctcagcctcccaagtagctgtgactaaaggtgcacgccgccatgcccagctaattttttgtattttagtagagacggggtttcaccgtgttgcccaggctgctctcagaactcctgagctcaggcagtccaccgcctcggcctaccgaagtgctaggattacagacgtaagccaccgagcctggtctagtttgcattttttttctatcagttttataagttaagaaataaaaggaattaatgtta

SEQ ID NO: 555 - DNA, 1612 bp, Homo sapiens
actttcacctttcctggtgatgcctttggctccttgagctgagttttgcccgagtggggctcatgagggaggatggagtttcttgggactactcagaccgccagttactgtggtcccaagaaatgctgtggcttgacctcactgccagctgtacaggcgccagtgatccaggaatgctatcagccctactacctgcccgggtaccgctacctcaattcatggaggcctagcctcttctacaagatagccaacgtccagacctgcccggacgagagcaccagtaccctgcggccgcccaccatcctgcccacactgcgctccgcactcttctctcgctatagcccccacgactgggaccagtccaaccagctgcaggtgcgtggggccgaggcctcccggctgtgggccagccggctgacggatgactccatgaggctcttgcaggacaaggaccagctgacgcaccagatgcaggagggcacctgccggaacctgggccagaggctgtcggacattggcttctggaagtcagagctgagctatgagctggacaggcttctgactgagaaccagaacttggagacggtcaagaggcggctggagtgcgcggccaatgaggtgaactgcccattgcaggtggccttggagtgtctgtaccatcgagagaagaggattgggattgatttggtccatgacaacgtggagaaaaaccttatccgggaagtggatttgctaaaatgttgccaagaacagatgagaaaattagctcaaagaattgatatccagatgcgggataaccgggatgctcagcacgtgctggagagggacctcgaagacaaaagctcggcccagtgtatcgatgagaagtgctttaacctgagaaatacgtcagactgcatcagcttcttccacggcatggagaaaattgacggcacgatctccgtacctgagacctgggccaagttcagtaacgacaacatcaaacactctcagaacatgcgggccaactccatccagctgcgggaggaggcggagcacctctttgagaccttgtcggatcagatgtggaggcagttcacagacaccaacctggccttcaacgcccgcatctctgaggtgacggatgtgaagaataagctgcagacgcagctggcgaagacgctgcaggagatcttccaggccgagaacaccatcatgctgctggaaaggtccatcatggccaaggagggcccgctgaaggtggcccagacaaggctggagtgccggacccggcgccccaacatggagctgtgcagggacatcccgcagttgaagctggtgaacgaggtgttcaccatcgacgacaccctgcagaccctcaagctgcggctgcgggagacacaggacacgctgcagctgctggtcatgaccaagtgccggctggagcacgagctcgccatcaaggccaacaccctctgcatcgacaaggagaagtgcatgggcatgcgtaagaccttcccctgcaccccgcgcctggtgggccacacctgagcaccgccctggcgcctcattccgcgctggcgtaaaattggaaaaggctgagaaacaaagtaaaacagtattttgtttgaaa

SEQ ID NO: 556 - DNA, 1198 bp, Homo sapiens
acagttttcacaaaggtctcttgatatcaaaacttctttccttgcatgcttctctgatcctgtggagatgaaaattgacatccatagtcatattctaccaaaagaatggccagatctaaaaaagaggtttggctacggaggctgggtgcagctccaacaccacagcaagggagaagcaaagttgttgaaagatgggaaagtcttcagagtggtgcgagagaattgctgggatccagaagttcgtattagagaaatggaccaaaaaggccaaacctgaggacactttaaacctgtgccagcttttaaacaacgaccttgccagcaccgttgtgagctaccccaggaggttcgtgggtctggggacgttgcccatgcaggcccctgagctggcggtcaaggagatggagcgctgtgtgaaagagctgggctttcccggggtccaaattggcacccacgtcaacgagtgggacctgaacgcgcaggagctctttcctgtctatgcggcagccgaaaggctgaagtgttccctgttcgtgcatccctgggacatgcagatggatggacgaatggccaaatactggctcccttggcttgtaggaatgccagcagagaccaccatagccatttgctccatgatcatgggtggagtatttgagaagtttcccaaactgaaagtgtgtttcgcacatggtggtggtgccttccccttcacagtgggaagaatctcccatggattcagcatgcgcccagatctgtgtgcccaggacaaccccatgaacccgaagaaataccttggttccttttacacagatgctttggttcatgatcctctgtccctcaagctgttaacagatgtcataggaaaggataaagtcattttgggaaccgattacccctttccactaggtgagctggaacctgggaaactaatagagtccatggaagaatttgatgaagaaacaaagaataaactcaaagccggcaatgccctggcatttttgggtcttgagagaaaacaatttgaatgactgaatttactacaaaggcaaactttcaaaaggatatctcatttttgtttctaaatatgtatcaacaggtatcaacaaaatcctattttgaactattttactcagaaatgaatgtcccaaatatcctaaattattcataataaaaatgatttgtaagtgttttcattctg

SEQ ID NO: 557 - DNA, 3704 bp, Homo sapiens
cgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaggaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggtaagaagaaggcggaaggcggcggaggcggcggtcgccccggggctccggcggcgggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcatttta

SEQ ID NO: 558 - DNA, 1570 bp, Homo sapiens
tagtgtcacgtgaggccccggtggcggcgcagctacggcaagagagtgagaaggaagggaagccggaaggggcgcgagtgaagcaaagcgaggacagacagctcgcagagggcgaggggtgcgtgtgcgtccgcttctcacctcaggtctcccttcggccccgctgccctccctcgcggctgggtgacagctgggtccggtccgtcgcgggctgcctggggtgcgaggatcgcgcaccccgtcttcgcgcgctgtgcctgccgccccgccccctcgtcccgcccgtcccgtcgcgtcgcgtcccgtcccctcgggtgctgccagccgggtgctgatgcgagtcggtggcagcgaggacattttctgactccctggcccctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagagag

SEQ ID NO: 559 - DNA, 1362 bp, Homo sapiens
taagactcatggacatagctttaattatctttgcctgacgcccaatacctgaaaattaagatgttcatgcaagataaagaggtaatttttctcctcctcccagtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccagatctctggaccggattcgtcccattctcgtcctcatggtggacaagaaactggtggtggttttcggaggcacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctccca

SEQ ID NO: 560 - DNA, 2970 bp, Homo sapiens
gagggcgggaagggccctctgtggggctgccattttggctgggacctaaatgcagtaaaggagcagctacgggaatatagagagtggggcttccaggcagagaagcctgcagtgcaaaggtctgcagacaacgacctgggcgtcttcaagggacacaaggaatcatattgccagaacacattgtacaggtagccaggtgtcggtctccagcctgagaactctggctgttgttccttgtgtcgtcccatattcctgcctggcctgcgatggacatcagcaagggcctcccaggcatgcagggaggcctccacatatggatctctgagaaccggaagatggtgccggtacccgagggggcttacgggaacttttttgaggaacactgctatgtcatcctccacgtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaacttgttcaacatccagcgactgctgcacatcaaagggaggaagcacgtgtctgccactgaggtggagctctcctggaacagctttaataagggtgacatcttcctgctggacctaggcaagatgatgattcagtggaatgggcccaagaccagcatttctgagaaggctcgggggctggctttgacctacagcctccgggacagggaacgtggtggtggtcgtgcacagattggtgtggtggatgatgaggccaaagccccggacctcatgcagatcatggaggctgtgctgggccgcagggtgggcagcctgcgtgccgccacgcccagcaaggatatcaaccagctgcagaaggccaatgttcgcctgtaccatgtctatgagaagggcaaagacctggtggtcctggagttggcgacccccccactgacccaggacctgctgcaggaggaggacttctacatcctggaccagggtggcttcaagatctatgtgtggcagggacgcatgtctagcctccaggagagaaaggctgccttcagccgggctgtgggcttcatccaggccaagggctacccgacctacaccaacgtggaggtggtgaacgacggcgccgagtcggccgcgttcaagcagctcttccggacttggtctgagaagcggcgcaggaaccagaagctcggcgggagggataaatcgattcatgtaaagctggacgtgggcaagctgcacacccagcctaagttagcggcccagctcaggatggtggacgacggctctgggaaggtggaggtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccatggaaaggggcagtcagcatccaccacaaggcttttccaagtgcaaggcactgacagccacaacaccaggaccatggaggtgccagcccgtgcctcatccctcaactccagtgacatcttcttgctggtcacagccagcgtctgctacctctggtttgggaagggctgtaatggtgatcagcgtgagatggcacgggtggtggtcactgtcatttccaggaagaatgaggaaacggtgctggagggtcaggagcctccccacttctgggaggccctgggaggccgggccccctaccccagcaacaagaggctccctgaggaggtccccagcttccagccacgactgtttgagtgctccagccacatgggctgcctggtcctcgcagaagtggggttcttcagccaggaggacctggacaagtatgacatcatgttactggacacctggcaggagatcttcctgtggcttggggaagctgcaagtgagtggaaggaggcggtggcctggggccaggagtacctgaagactcacccagcagggaggagcccggccacacccatcgtgctggtcaagcagggccatgagcctcccaccttcattggatggttcttcacttgggacccctacaagtggactagccacccgtcccacaaggaagtggtggatggcagcccggcagcagcatcaaccatctctgagataacagcagaagtcaacaacttgcggctatccagatggccgggcaatggcagggcaggtgccgtggccctgcaggccctcaagggctcccaggacagctcagagaatgatctggtgcgaagccccaagtcggctggcagcagaaccagcagctccgtcagcagcaccagcgccacgatcaacgggggcctgcgccgggaacaactgatgcaccaggctgttgaggacctgccagagggcgtggaccctgcccgcagggagttctatctctcagactctgacttccaagatatctttgggaaatccaaggaggaattctacagcatggccacgtggaggcagcggcaggagaaaaagcagctgggcttcttctgaacccaagccctctcgactgcccctatcccctggaccccaacatacctacaatgctggggaggccctgcttccactcccctcagaggcttttggtcatcctctgcgtgtcagtaaaagcaggcagcccatacga

SEQ ID NO: 561 - DNA, 1581 bp, Homo sapiens
ctcgccgctgccccggctccgccgctcgcagagagattcggaggagcccgggcgggggggaggaggagggggaggagggagcggagatctcggggctcggagccggccgccgctccgctccgatcgctgtggggcttggttttttgggggtgggggggcgggggggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccaggcttcccagcagcggcttatggaccagtggcagcagcggcggtggcggcagcaagaggatcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttat

SEQ ID NO: 562 - DNA, 2129 bp, Homo sapiens
gggacagagctggctcacaagccctccctgctctgtgacatgtctgtttcctgtttctcccccatcaggagcagtttcagtctcaacttcaaaagaacaaacgcgcactcaaaacaaaggaagaccgtcctcgactgcagaggaagcaggaagctgtcggcccagctctgagcccagctgctggagccccgagcagcggcatggagtccgtggccctgtacagctttcaggctacagagagcgacgagctggccttcaacaagggagacacactcaagatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaactatggagaccaggtgcagcacttcaaggtgctgcgtgaggcctcggggaagtacttcctgtgggaggagaagttcaactccctcaacgagctggtcgacttctaccgcaccaccaccatcgccaagaagcggcagatcttcctgcgcgacgaggagcccttgctcaagtcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctggccaacgggcctttttacaggaactgaggtccagagaggacatggacacccccagctctgtcagagtcacacggggctcagtggacggccttggactgaacgtgggctcctaactgcctccggccgctctgcacaaactgggatggcccaggtcccccagcaagggtacccagcaagggtagctccggggcttcctggctggttgctttccattggctgccagctgtgtgacaccacagggcggagtctgtggaggccccgcccacctcctcttgtcaatggccccatctgccaggaaggttgaggactcccaggtttcacccactggaggctcaacctaaggaaccctggccatggtgggtgggttcaccttgggctgaccacccactgggcctgcctgcccctccctcaaaaggcccctggagttgttcaggctgttgggaggtggctcagcctcgaaggacagactgcacacctgttgacctaaactcactggacagactccaggtggacaccaactcctcaacagccccatgacttcagctccacctggggcacccagcaccccaccacagggctagaggccctaagaccctgaaaaaggggcgggcagtagggaaggtggaggcacactcctcttctgttggacaggtgagctctgagggcaagccctgggcccagccacgcagagaccctggctgccctggctcttgtttgtttaggcccaggttctgcccagaccggggcccagcagagctctcaggaggctgagaaacctccagggcagacagaaagttggggccagagctaggttttagagatcctacaggatcccacatgggacggctacctaggtggggcacggcccctacccgagaacaggagggtcctccagagaatgtgccatgatcagggatatgagcagggcctgcccagagcctgggcacctttgggagagggaaaagtgaggtgggacttggaaaggctttgaacgccaggctgatggttgagggatggtgggcagggagggagggcgaagaggctccctctggcatttgggagccggtgggtggagggaggagcccttggaggtggctgcagtcccttaatggggggccttgctctgggcatgtggggctcttcctccatccagagctggcccaagacccttagaaccctgagtgctggcaaatctcactgctcctgacccagcctgtgtattcaaaacgaaaacagtaaaaccaacatcaggatg

SEQ ID NO: 563 - DNA, 898 bp, Homo sapiens
cccgagcgccggccgggccatgacccccgctgctctgtcttgcaggctcgtcgccgcggccccccgagcccgaccgccgccgccaccaccaccagcgcccgggcgggcctcgcgcgcctcgggcgcggctccgcagtgagcccaccaagaaggaagcggcctgcagaggtgccgacatggggcttaagatgtcctgcctgaaaggctttcaaatgtgtgtcagcagcagcagcagcagccacgacgaggcccccgtcctgaacgacaagcacctggacgtgcccgacatcatcatcacgccccccacccccacgggcatgatgctgccgagggacttggggagcacagtctggctggatgagacagggtcgtgcccagatgatggagaaatcgacccagaagcctgaggaggtgtcctgggtttggctggctggctcctgctccagcggcccggcttcaggtgtccgggggcgtggctgcctggagcaggtgtgctgaataccctggatgggaactgagcgaacccgggcctccgctcagagagacgtggcaggaccagcgaggaatccagcctgtccacttccagaacagtgtttcccaggccccgctgagtggaccggacctctgacacctccaggttcttgctgactccggcctggtgaaagggagcgccatggtcctggctgttggggtcccagggagaggctctcttctggacaaacacaccctcccagcccccagggctgtgcaaacacatgcccctgccataagcaccaacaagaacttcttgcaggtggagtggctgttttttataagttgttttacagatacggaaacagtccaaaatgggatttataatttcttttttgcattataaataaagatcctctgtaacaaa

SEQ ID NO: 564 - DNA, 20432 bp, Homo sapiens
tgcctcccagcctgtgcccccagcctgcgtgctgcccagagcccccatagagagaggtccccgccgccaccctcatggatcagccacagttcagcggggcgccccgctttctcacccggcccaaggccttcgtggtgtcggtgggcaaggacgccaccctcagctgccagatcgtgggtaatcccacgccacaggtgagctgggagaaggaccagcagccggtggcggccggcgcgcgcttccgtctggcccaggacggcgacctctaccgcctcactatcctggacctggcgctgggcgacagtgggcaatacgtgtgccgcgcgcgcaatgccataggcgaggccttcgctgctgtgggcctgcaggtggacgcggaggccgcgtgcgccgagcaggcgccgcacttcctgctgcggcccacgtccatccgcgtgcgcgagggctcagaggccaccttccgctgccgcgtgggtggctccccgaggccggcagtgagctggtccaaggacgggcggcgcctgggtgagcccgacggcccccgcgtgcgcgtggaggagctcggcgaggcaagtgcgctgcgcattcgggcggcgcggccgcgcgacggcggcacttacgaggtccgcgccgagaacccgctgggcgctgccagcgccgccgcggcgctagtggtggactcggacgccgcggacacggccagccggcccgggacctccacggccgcgctcctggcgcacctgcagcggcggcgcgaggctatgcgcgccgagggcgcccccgcctcaccgcccagcaccggcacgcgcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcgagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactaaccatctcccagtgctgcctggaggatgtgggccaggtggcctttatggctggcgactgccagacgtccacccagttctgcgtgtcggcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggtggtgtttgctaaggagcagctggcacgcaggaagctgcaggcagaggcaggagccagtgccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaagagcccaaggtggtgtttgccaaggaccaggtggcacacagtgaggtgcaggctgaggcaggggccagtgccacgctgagctgcgaggtggcccaggcccagacggaggtgatgtggtacaaagatgggaagaagctgagctccagcttgaaagtgcatgtagaggccaagggctgcagacggaggctggtggtgcagcaggcaggcaagacagatgccggggactacagctgcgaggccaggggccagagggtctccttccgcctgcacatcacagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacagagcccaagggggtgtttgcgaaggagcagtcagtgcataatgaggtgcaggctgaggcggggaccactgccatgctgagctgtgaggtggcccagccccagacagaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggtcgccggggagtacagctgcgaggcggggagccagcggctctccttccacctgcacgtggcagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcttcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacagctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccccacagccagtgttccgggagccgctgcagagtctgcaggcggaggagggctccacggccaccctgcagtgtgagctgtctgagcccactgctacagtggtctggagcaagggtggcctgcagctgcaggccaatgggcgccgggagccacggcttcagggctgcaccgcggagctggtgttacaggacctacaacgtgaagacactggcgaatacacttgcacctgtggctcccaggccaccagtgccaccctcactgtcacagctgcgcctgtgcggttcctccgagagctgcagcaccaggaggtggatgagggaggcaccgcacacttatgctgcgagctgagccgggcgggtgcgagcgtggagtggcgcaagggctccctacagctcttcccttgtgccaagtaccagatggtgcaggatggtgcagctgcagagctgctggtacgcggagtggagcaggaggatgcgggtgactacacgtgtgacacgggccacacgcagagcatggccagcctctctgtccgtgtccccaggcccaagttcaagacccggcttcagagtctggagcaggagacaggtgacatagcccggctgtgctgtcagctgagtgatgcagagtcgggggccgtggtgcaatggctcaaggagggcgtggagctgcatgcgggccccaagtacgagatgcggagccagggggccacgcgggagctgctgatccaccaactggaggccaaggacacgggcgagtatgcctgtgtgacaggcggccagaaaaccgctgcctccctcagggtcacagagcctgaggtgaccattgtacgggggctggttgatgcggaggtgacggccgatgaggatgttgagttcagctgtgaggtgtccagggctggagccacaggcgtgcagtggtgcctacagggcctgccactgcaaagcaatgaggtgacagaggtggctgtgcgggatggccgcatccacaccctgcggctgaagggcgtgacgcccgaggacgctggcactgtctccttccatttgggaaaccatgcttcctctgcccagctcaccgtcagagctcctgaggtgaccatcctggagcccctgcaggacgtgcagctcagtgagggccaggatgccagcttccagtgccggctatccagagcttcaggccaggaggcccgctgggctttaggaggggtgcccctgcaggccaacgagatgaatgacatcactgtggagcagggcacactccacctgctcaccctgcacaaggtgacccttgaggatgctggaactgtcagtttccacgtgggcacgtgtagctctgaggcccagctgaaagtcacagccaagaacacggtggtgcgggggctggagaatgtggaggcgctggagggcggcgaggcgctgttcgagtgccagctgtcccagcccgaggtggccgcccacacctggctgctggacgacgaacccgtgcacacctcggagaacgccgaggtggtcttcttcgagaacggcctgcgccacctgctgctgctcaaaaacttgcggccacaagacagctgccgggtgaccttcctggctggggatatggtgacgtccgcattcctcacggtccgaggctggcgcctggagatcctggagcctctgaaaaacgcggcggtccgggccggcgcacaggcatgcttcacctgcacgctcagcgaggcggtgcccgtgggagaggcgtcctggtacatcaatggcgcggcagtgcagccggatgacagcgactggactgtcaccgccgacggcagtcaccacgccctactgctgcgcagcgcccagccccaccacgccggggaggtcaccttcgcttgccgcgacgccgtggcctctgcgcggctcaccgtgctgggcctccctgatcccccagaggatgctgaggtggtggctcgcagcagccacactgtgacactgtcttgggcagctcccatgagtgatggaggcggtggtctctgtggctaccgcgtggaggtgaaggagggggccacaggccagtggcggctgtgccacgagctggtgcctggacccgagtgtgtggtggatggcctggcccccggggagacctaccgcttccgtgtggcagctgtgggccctgtgggtgctggggaaccggttcacctgccccagacagtgcggcttgcagagccaccgaagcctgtgcctccccagccctcagcccctgagagccggcaggtggcagctggtgaagatgtctctctggagcttgaggtggtggctgaggctggtgaggtcatctggcacaagggaatggagcgcatccagcccggtgggcggttcgaggtggtctcccagggtcggcaacagatgctggtgatcaagggcttcacggcagaagaccagggcgagtaccactgtggcctggctcagggctccatctgccctgcggctgccaccttccaggtggcactgagcccagcctctgtggatgaggcccctcagcccagcttgccccccgaggcagcccaggagggtgacctgcacctactgtgggaggccctggctcggaaacgtcgcatgagccgtgagcccacgctggactccattagcgagctgccagaggaggacggccgctcgcagcgcctgccacaggaggcagaggaggtggcacctgatctctctgaaggctactccacggccgatgagctggcccgcactggagatgctgacctctcacacaccagctctgatgatgagtcccgggcaggcaccccttccctggtcacctacctcaagaaggctgggaggccaggcacctcaccactggccagcaaggttggggccccagcagccccctctgtgaagccacagcagcagcaggagccactggctgctgtgcgcccaccactgggagacctgagcaccaaagacctgggtgatccctcaatggacaaggcagctgtgaagatccaggctgcctttaagggctacaaggtccggaaggagatgaagcagcaggaagggcccatgttctcccacacatttggggacaccgaggcacaggtgggggatgccctgcggctggagtgtgtcgtggccagcaaggcagatgtgcgagcccgctggctgaaggatggtgtggagctgaccgatgggcggcaccatcacatcgaccagcttggggatggcacctgctctctgctgatcactggcctggaccgtgctgatgctggctgctacacctgtcaggtgagcaacaagtttggccaggtgacccacagtgcctgtgtggtggtcagtgggtcagagagtgaagccgagagctcctctgggggtgagctggacgatgccttccgccgggctgcccgtcggctgcaccggctcttccgcaccaaaagtccggctgaagtttcagatgaggagctcttcctgagtgcagacgagggccctgcagagccagaggagcccgcggactggcagacataccgcgaagatgagcatttcatctgcatccgttttgaggcgctcactgaggcccgccaggcggtaactcgcttccaggagatgtttgccacactgggcattggggtggagatcaagctggtggaacaggggcctcggagggtagagatgtgcatcagcaaagagactcctgcccctgtggtgcctccagagccattgcccagcctactgacttctgacgctgccccagtgttcctgactgagttgcagaaccaagaagtgcaggatgggtatcctgtgagctttgactgcgtggtgacaggtcagcccatgcccagtgtgcgctggttcaaggatgggaagttgttggaggaggatgatcactacatgattaatgaagaccaacagggtggccatcagctcatcatcacagccgtggtgccagcagacatgggcgtctaccgctgcctggccgagaacagcatgggtgtctcctccaccaaggctgagctccgtgtggacttgacaagcacagactatgacactgcagcagatgccacggagtcctcatcctacttcagtgcccaaggctacctgtccagccgggagcaggagggaacagagtccaccactgatgagggccagctgccccaggtggtggaggagctgagagacctccaggtggcccctggcacacgcctggccaagttccagctcaaggtgaaaggctaccctgctcccagattatactggttcaaagatggccagcccctgaccgcatctgcccacatccgcatgactgacaagaagatcctgcacaccctggagatcatctccgtcacccgggaggactctggccagtatgcagcctatatcagcaatgccatgggtgctgcctactcgtctgcccggctgctggttcgaggccctgatgagccagaagagaagcctgcatcagatgtgcatgagcagctggtgccgccccgaatgctggagaggttcacccccaagaaagtgaagaaaggctccagcatcaccttctctgtgaaggtagaaggacgcccggtgcccaccgtgcactggctcagggaggaggctgagagaggcgtgctgtggattggccctgacacaccgggctacaccgtggccagctctgcgcagcagcacagcctggtcctgctggacgtgggccggcagcaccagggcacctacacatgcattgccagcaacgctgccggccaggccctctgctccgccagcctgcacgtctcgggcctgcctaaggtggaggagcaggagaaagtgaaggaagcgctgatttccactttcctgcaggggaccacacaagccatctcagcacaggggttggaaactgcgagttttgctgaccttggtgggcagaggaaagaagagcctctggctgccaaggaggccctcggccacctgtccctcgctgaggtgggcacagaggagttcctgcagaaactgacctcccagatcactgagatggtatcggccaagatcacgcaggccaagctgcaggtgcccggaggtgacagtgatgaggactccaagacaccatctgcatccccccgccatggccgatcacggccatcctccagcatccaggagtcttcctcagagtcagaggacggcgatgcccgaggcgagatctttgacatctacgtggtcaccgctgactacctgcccctaggggctgagcaggatgccatcacgctgcgggaaggccagtatgtggaggtcctggatgcagcccacccactgcgctggcttgtccgcaccaagcccaccaagtccagcccctcacggcagggctgggtgtcaccagcctacctggacaggaggctcaagctgtcacctgagtggggggccgctgaggcccctgagttccctggggaggctgtgtctgaagacgaatacaaggcaaggctgagctctgtgatccaggagctgctgagttctgagcaggccttcgtggaggagctgcagttcctgcagagccaccacctgcagcacctggagcgctgcccccacgtgcccatagctgtggccggccagaaggcagtcatcttccgcaatgtgcgggacatcggccgcttccacagcagcttcctgcaggagttgcagcagtgcgacacggacgacgacgtggccatgtgcttcatcaagaaccaggcggcctttgagcagtacctggagttcctggtggggcgtgtgcaggctgagtcggtggtcgtcagcacggccatccaggagttctacaagaaatacgcggaggaggccctgttggcaggggacccctctcagcccccgccaccacctctgcagcactacctggagcagccagtggagcgggtgcagcgctaccaggccttgctgaaggagctgatccgcaacaaggcgcggaacagacagaactgcgcgctgctggagcaggcctatgccgtggtgtctgccctgccacagcgcgctgagaacaagctgcacgtgtccctcatggagaactacccaggcaccctgcaggccctgggcgagcccatccgccagggccacttcatcgtgtgggagggtgcaccgggggcccgcatgccctggaagggccacaaccgtcacgtgttcctcttccgcaaccacctggtaatctgcaagccccggcgagactcccgcaccgataccgtcagctacgtgttccggaacatgatgaagctgagcagcatcgacctgaacgaccaggtggagggggatgaccgcgccttcgaggtgtggcaggagcgggaggactcggtgcgcaagtacctgctgcaggcacggacagccattatcaagagctcgtgggtgaaggagatctgtggcatccagcagcgtctggccctgcctgtgtggcggcccccggactttgaagaggagctggccgactgcacagccgagctgggtgagacagtcaagctggcctgccgcgtgacgggcacacccaagcctgtcatcagctggtacaaagatgggaaagcagtgcaggtggacccccaccacatcctcattgaagaccctgatggctcgtgtgcactcatcctggacagcctgaccggtgtggactctggccagtacatgtgcttcgcggccagcgccgctggcaactgcagtaccctgggcaagatcctggtgcaagtcccaccacggttcgtgaacaaggtccgggcctcaccctttgtggagggagaggacgcccagttcacctgcaccatcgaaggcgccccgtacccgcagatcaggtggtacaaggacggggccctgctgaccactggcaacaagttccagacactgagtgagcctcgcagcggcctgctagtgctggtgatccgggcggccagcaaggaggacctggggctctacgagtgtgagctggtgaaccggctgggctccgcgcgggctagtgcggagctgcgcattcagagccccatgctgcaggcccaggagcagtgtcacagggagcagctcgtggctgcagtggaagtcactgagcaagagactaaagtccccaagaaaaccgtcatcatagaagagaccatcaccactgtggtgaagagcccacgtggccaacgacggtcccccagcaagtccccctcccgctcaccttcccgctgctctgccagcccgctgaggccaggcctactggcccccgacctgctgtacctgccaggtgctggccagccccgcaggccggaggcagaaccaggccagaagcccgtggtgcccacactgtatgtgacggaggccgaggcccactctccagctctgcccggactctcggggccccagcccaagtgggtggaggtggaggagaccattgaagtccgggtgaagaagatgggcccgcagggtgtgtctcccaccacagaggtgcccaggagctcatcggggcatctcttcacactgcccggtgcgacccccggaggggaccccaattccaacaactccaacaacaagctgctggcccaggaggcctgggcccagggcacagccatggtcggcgtcagagagccccttgtcttccgcgtggatgccagaggcagtgtggactgggctgcttctggcatgggcagcctggaggaggagggcaccatggaggaggcgggagaggaagagggggaagacggagacgcctttgtgacggaggagtcccaggacacacacagccttggggatcgtgaccccaagatcctcacgcacaacggccgcatgctgacactggctgacctggaagattacgtgcctggggaaggggagaccttccactgtggtggccctgggcctggcgcccctgatgaccctccctgcgaggtctcggtgatccagagagagatcggggagcccacggtggggcagcctgtgctgctcagcgtggggcatgcactgggtccccgaggccctctcggcctctttaggcctgagccccgtggggcgtcaccaccgggaccccaggtccgtagccttgagggcacctccttcctcttgcgggaggccccggctcggcctgtgggcagtgctccctggacgcagtctttctgcacccgcatccggcgttctgcggacagtggccagagcagcttcaccacagagctttccacccagaccgtcaacttcgggacagtgggggagacggtcacccttcacatctgcccagacagggatggggatgaggcggcacagccctgatgctgctgccatggtggcttggggcagcggggagaaaggagtgtccttgaggcctaggacgctgcccggcctcagcagcagccctgggagcctcctgagggccctccctgtccctggccacgggcccttcttacctcactcaacttcagccaggaggactgggtggtgcttgcaatgttggaatgaccggctcaaagacctcagctctgggctgtttcctgtcagcctggcaggagcctcaggactgtggacgaaggatgtggccttgggcatttgtcctgttcccacatgggcctggtccctccctcctggccccagccacagctgccaggcctgacatggccttgcctctcctgcagtcttggtgactgagacccttgggtggcgcttcccagctctgcaggccctcctggccttttctgcagggtggacacagggtctgtgtgtgggcagcagcccctgtctctcagcaagaataaagcagcttcctgtgca

SEQ ID NO: 565 - DNA, 2715 bp, Homo sapiens
cttccgcctcggctcctcttcctgccggcatccgggatccctacgtcccgcgtcccccgagcgctcggagcctacgcgcccagcgctaccgaaacccagagtcctgcgccctggagtccccgcgccccggagcccgagcacccgggagtcccgagcctcgcgccccggagtgcccgagcctgcgccgccgcacccggataccccgcgtccccgcgagctgccgaggccgcccgccgccgccccgcggacagtaccgccttcctcccctctgtccgcgccatggccgcccccgacctgtccaccaacctccaggaggaggccacctgcgccatctgcctcgactacttcacggatccggtgatgaccgactgcggccacaacttctgccgcgagtgcatccggcgctgctggggccagcccgagggcccgtacgcgtgccccgagtgccgcgagctgtccccgcagaggaacctgcggcccaaccgcccgcttgctaagatggccgagatggcgcggcgcctgcacccgccgtcgccggtcccgcagggcgtgtgccccgcgcaccgcgagccactggccgccttctgtggcgacgagctgcgcctcctgtgtgcggcctgcgagcgctctggggagcactgggcgcaccgcgtgcggccgctgcaggacgcggccgaagacctcaaggcgaagctggagaagtcactggagcatctccggaagcagatgcaggatgcgttgctgttccaagcccaggcggatgagacctgcgtcttgtggcagaagatggtggagagccagcggcagaacgtgctgggtgagttcgagcgtcttcgccgtttgctggcagaggaggagcagcagctgctgcagaggctggaggaggaggagctggaggtgctgccccggctgcgggagggcgcagcccacctaggccagcagagcgcccacctagctgagctcatcgccgagctcgagggccgctgccagctgcctgctctggggctgctgcaggacatcaaggacgccctgcgcagggtccaggatgtgaagctgcagcccccagaagttgtgcctatggagctgaggaccgtgtgcagggtcccgggactggtagagacactgcggaggtttcgaggggacgtgaccttggacccggacaccgccaaccctgagctgatcctgtctgaagacaggcggagcgtgcagcggggggacctacggcaggccctgccggacagcccagagcgctttgaccccggcccctgcgtgctgggccaggagcgcttcacctcaggccgccactactgggaggtggaggttggggaccgcaccagctgggccctgggggtgtgcagggagaacgtgaacaggaaggagaagggcgagctgtccgcgggcaacggcttctggatcctggtcttcctggggagctattacaattcctcggaacgggccttggctccactccgggacccacccaggcgcgtggggatctttctggactacgaggctggacatctctctttctacagtgccaccgatgggtcactgctattcatctttcccgagatccccttctcggggacgctgcggcccctcttctcacccctgtccagcagcccgaccccgatgactatctgccggccgaaaggtgggtccggggacaccctggctccccagtgactcgggccctcctggaggagtcctgttgcctctcctgcccctccaggccactgagtgttttggccacttggaggacctgggaggagggagtgtgtcctttgagcaagaggaggaactcctggtgcctttctgagcctgcgtgggagaaccccaattctagcactccaggaaactgtgggagagtgtggggcaggctccgtcctccctgggagacccctccagccaccgggtgccacttaatgccaacagcccttaccaaagctgggagccccattgccccggcagctctggcctgtggttccagaagctgagaaaactccactggggcttgcagaatccagggttcacctaagctgcacagttcctgcagctttgccagccccctgaaagtcttgtgtaccccacctctgaagatgctgggggaggcagctgggatgggagccagccccatgcctgtctgtgaccccacagtgggtgagagcccgtcacagtcctgggtgtggctgctctggaagaattaggaggcagccataataagagtcttcagagagatgatgggaggggccagtgaggacaggaacagagagtagatgtcctataataaaggggcttctgggaggtgcctgggcacagatgtctgttcagcaggtgtgtgggcctagaggagagagcagagcccagaaatgtcttttgcaggcccacgttctgacttgaagctttcgtgggcatgttgccattgggttttgcccttgcaaaggcttcctaggtctccagtggcccctcaggacccagggtcccagctgctgcttggggatgtgcactgctggccgccggccttgcagtctctctaccctggggaggaacagtggcttctcagagcctggggcatacagaagaaggcaggagttgatttttgtgttgggtttggggtttctttgtcctcaaggtactgttctgtttctctttacccctctgctttatttattgtaagcattcccacgttaaataaactttggctgttgtctacaa

SEQ ID NO: 566 - DNA, 5157 bp, Homo sapiens
gagctgcgctttagctgctgcgccacgcgcgcctcgggcctgggcgcagaggatcggccgggcgcggcgggaaggaggctgcgggcagcgaggagcggctggcgctcgaggcggcggacggcaccatgtccccggggagcggggtgaagagcgagtacatgaagcgctaccaggagccgcgctgggaggagtacgggccgtgctaccgcgagctgctgcactaccgcctaggccgccggctgctggagcaggcgcacgcgccctggctctgggacgactggggcccggccggctcctcggaggactcggcgtcgtcagagtcgtcgggcgccgggggccccgcaccccggtgcgccccgccctcgcccccgccgcccgtagagccggcgacccaggaggaggcggaacggcgggcgcgcggggccccggaggagcaggacgcggaggccggggacgcggaggccgaggacgcggaggacgcggctctgccagcactgccagtgaaagatgtagaagataaacctgaacaacaaaccagaacaagagagactgacaaatcacccaccagtactgagcctcgacagcaaccaagtgccttatttgctagaggaaacaggaaagcggtcaaaagtccccaaagatcatcgagtaaaataaaagaaaacaagcatccatttgctctttatggctggggagaaaaacagaccgatacaggaagccagaagactcacaacgtctgtgcgtccgctcctgtgcacgagattcatgaatcagcattacgagccaagaacagaagacaggtggaaaaaaggaaactggttgctcaaaggcagcgagctcactctgtggatgtggagaagaacagaaagatgaaggcttcctcctcagagaacccgtggatgacagaatacatgaggtgctattcggcaagagcttaaagaaacacttgcgtggacagcctcttttaaaaagtgtaaatgactgaaaggaaaaacaaaacaaaaaccatcaaaagaaacggacacaggtttaagaaaccaactgattatgcaaggttttttttagggaatttgtaaaagattgttttattttgatgaatattggtcacctacctcggcagtagggcagacagttgaagccatagacatttggttatttatgaagataattccctaaatctttgatattcttataaggtttttgttttaaagcatcttaatcttttaagatactgacaccaaatgcctttaaatggcaacagatgcttacagttcagtattcttttcataagcttaggtagagcctattatcatcttgttctaaataactttccagattccatagctataagatcattccatcctacagcataagactcgttttccttatatgccgttttgtttgtgaaagaatatcaagtcaaaaatgagtgtcagcactactactgattccatgtataatgaaagtagaactttgctagttcctgaaaatttttaacttatttgtatttcagttcagcagcatctttatgtagattgtgatatttaagaattatctgggctgggcgagggtctctttttctctttcagtgatcatctaggcagttattatttaatagtttaatagctcaagtacattccaatagacgaagtgcacacaacacaatatgtgtgtacagtagtagtaaagtttcttttgagtagtcaaagactcactttttttattgcctttttttttttttttaaagaatacatactgtggattcagtcccttgtcacacttgaccttttggcatacacccactgtggacttttgcctcttctgtaatggctggcaatgacatttcaaacttacaatctggaattgcacttggtacattggcattgcttgttccactgggatggggaccagtgtgaagatgcctgttagatagactgcccacccctactttctctttttctttatagcacttaacaataacaaagtcttgatgatgtacagtattcaaactttaggttgaaatacgttactctttgattcctagccagtagatcttatctacactttaatgggagagaatggtggtgtgtgggtaggcacaaatttatgtaaatagtgctccttctctttagtatgtttgctttgggggtagaaaaatggttttaacaaacactggtttccatcaaatgaatgatgtcttctccatcctgtggagacaagaatctgctagaaggatatgtgctaagttccttataagagataatggtgctctgcctatgccagcttggcacccgaagatgtgtgagtggacgtgaggctgagtattaccttagtatttttctctgggtctttggaaaaccatagtcaatttttagaacatattgctttcattccccataaactcttcacacatgataactgtttaagctttgaaaacacatactgaagtattgtgagcttaaaaaaactttttaaatatttgcatagttttgaggtgaatttgtttccttacagatctctcctaatcattgagatgtatatttcaaaagaggaaattttacatgttgtccaaaacagccttgctagtaactggtgaattttggtattaactattattaaagtctttaaacgacacaggtacctaaagatcaccttaatgtggcaatttgtgatggtgtagctagctgattgtgaaaactgttcctttaaagtcgcttcttgcatgttcggtgttagtcatccagctcaggcttgtgttgcagctgacaatctaggaaagacggccttagagagtggtgcaggccccacactgacggactgccttagaaacccgacttcctctagactttgaaccgccagacttttctcttgtttagaaaacaaacttatatttaatgtacttactacttaaaactccagacagagatataatgtagaaggcaaatattggccaattttttcctctttttaagtggaagacaaatgaacgggatttttaaagtgcttttaaagtgcatgaatggttaataaatcagtatgaattgtaagccttcatcttacatccaagtccttagttggttagggtttcttttctttcttttttaaagagtgtcaattaccttttgaacctgtgaaaatttgatagttgttaacagtctgatggtcctaattctttcttttcattctagaaatgaatgtggttgtaatcatgttcctaattcttgggacaacctgcaagacagtgagacagtttaaaaattacctttcatgttgaaaaagtctgaaacagagaacccaatgatatttaaaataaatgctacataaaactctttttaaaattttgattttaacttaattaaaacaatgtcataaatatgctttttgattttgttactgcttttaatattaaagtaatagaatattgaagcaatattgtctagcactctgctggacattaagtccgcgggaggagaagtgaacaggaatcgattctttgtcttttaactgcccttagttaggagatgttaaaatacttggcacctctggttatatgtatgttatgtgtgttctcccccctaaaatttctaagcacatttattcacttttaaaatgaatctttaaaagattatagttagtagttatagttaatattctatttacttggaaaaatgtgaataaatggatcttcaaaagattcattttaaaaatgaataaatgtataataggctataggtgatcttacttgcgtattaggtaggaggcacatatttataccatttcatatgtaatatctttgtcattgtgtttcatcgaagatcaattgctagcaacttgaagggtatttatacttgggtcacttgaactcagctgactaaattgtaagaacgagagcaagcaagatggctgttattggaagccataacttccagaagataattctgcacaattcgtaagttaaaaaaaatctgtagggtcttccactatcctttttcaggttgataatgctgttctgggcacacactttgtaaatggaatgttatggtacagtcgcctctcagtatccatggggcattggttccaggcctcccttaggatgccaaactccatggatactcaaaccccttctataaaatggtgtagtatttgcatatatcctagacacatcctcctgtatgctttaaatcatctctagattacttaaaatacctaatacaatgtaaatgctctgtaaatagttgttatactatattgtttagggaataatgacaaggaaaaaaaagcctgtacatgttcagcacaagtgaaaccatcctttttgcccccaaatattttcaatttgtatttggttgaatccatggatgcagaactcacggatacagagggccgactgtactttctttaaagtgttcaaaagtattactagcaaagaggaggaggagcaaagcatatatcagaagtaaaacaatttttcttgttgactgctttggtaaaaaacagtttgatggatagttttacatttcactggactagataaaaaatggtgctaatatttatgtagcttgatgctatagttgctttggtatcaaacttaatacctaacccatataagatccttattatataattttgtgatcagtaaaatgatattttaaagagtgatcttaaaaatatgacctggtcattgcacaacgtttgcatttgaaatgaatttgtgtactatagggtggatatggagttattcagtgcaagtgtgtgcttaatatcaaaccctatgcaaggagctatgtctagatttttggtccaaatttgcctccttcaagcctactagtgtgagatggaaaaaaatcgattgctcttttaatattatttccattttgaaattctcgacacttgaatgaaggcagtagaggcctctttttggatttctcttctaataacaaaactttatttagggaaggtttccctgtgctatcgtaagtttgttttgagcactgcattcactttaaaattctggaggaacaaaggctgggcacataatcacaaagcccaggccacacaataattcggggttgtattttctaagaactatgtattgtttttagcttatagttaatattgtatttacttggaaaaatgtgaataaagttaattaacatt

SEQ ID NO: 567 - DNA, 5272 bp, Homo sapiens
cgccccgggcgccggctgcgtcccggcctcctcctcctcttcctccgccctccttggctgggaaagtgggaggcggcggcggcggcgtggtgtgtgtgcgcgcgtgaggggggcagcagagaggagtctcccggtgccgccgcggcgtcagagacactgcgagcggcgagcgcggtggggccgcatctgcatcagccgccgcagccgctgcggggccgcgaacaaagaggaggagccgaggcgcgagagcaaagtctgaaatggatgttacatgagtcattttaagggatgcacacaactatgaacatttctgaagattttttctcagtaaagtagataaagatggatgaatcagccttgttggatcttttggagtgtccggtgtgtctagagcgccttgatgcttctgcgaaggtcttgccttgccagcatacgttttgcaagcgatgtttgctggggatcgtaggttctcgaaatgaactcagatgtcccgagtgcaggactcttgttggctcgggtgtcgaggagcttcccagtaacatcttgctggtcagacttctggatggcatcaaacagaggccttggaaacctggtcctggtgggggaagtgggaccaactgcacaaatgcattaaggtctcagagcagcactgtggctaattgtagctcaaaagatctgcagagctcccagggcggacagcagcctcgggtgcaatcctggagccccccagtgaggggtatacctcagttaccatgtgccaaagcattatacaactatgaaggaaaagagcctggagaccttaaattcagcaaaggtgacatcatcattttgcgaagacaagtggatgaaaattggtaccatggggaagtcaatggaatccatggctttttccccaccaactttgtgcagattattaaaccgttacctcagcccccacctcagtgcaaagcactttatgactttgaagtgaaagacaaggaagcagacaaagattgccttccatttgcaaaggatgatgttctgactgtgatccgaagagtggatgaaaactgggctgaaggaatgctggcagacaaaataggaatatttccaatttcatatgttgagtttaactcggctgctaagcagctgatagaatgggataagcctcctgtgccaggagttgatgctggagaatgttcctcggcagcagcccagagcagcactgccccaaagcactccgacaccaagaagaacaccaaaaagcggcactccttcacttccctcactatggccaacaagtcctcccaggcatcccagaaccgccactccatggagatcagcccccctgtcctcatcagctccagcaaccccactgctgctgcacggatcagcgagctgtctgggctctcctgcagtgccccttctcaggttcatataagtaccaccgggttaattgtgaccccgcccccaagcagcccagtgacaactggcccctcgtttactttcccatcagatgttccctaccaagctgcccttggaactttgaatcctcctcttccaccaccccctctcctggctgccactgtccttgcctccacaccaccaggcgccaccgccgctgctgctgctgctggaatgggaccgaggcccatggcaggatccactgaccagattgcacatttacggccgcagactcgccccagtgtgtatgttgctatatatccatacactcctcggaaagaggatgaactagagctgagaaaaggggagatgtttttagtgtttgagcgctgccaggatggctggttcaaagggacatccatgcataccagcaagataggggttttccctggcaattatgtggcaccagtcacaagggcggtgacaaatgcttcccaagctaaagtccctatgtctacagctggccagacaagtcggggagtgaccatggtcagtccttccacggcaggagggcctgcccagaagctccagggaaatggcgtggctgggagtcccagtgttgtccccgcagctgtggtatcagcagctcacatccagacaagtcctcaggctaaggtcttgttgcacatgacggggcaaatgacagtcaaccaggcccgcaatgctgtgaggacagttgcagcgcacaaccaggaacgccccacggcagcagtgacacccatccaggtacagaatgccgccggcctcagccctgcatctgtgggcctgtcccatcactcgctggcctccccacaacctgcgcctctgatgccaggctcagccacgcacactgctgccatcagtatcagtcgagccagtgcccctctggcctgtgcagcagctgctccactgacttccccaagcatcaccagtgcttctctggaggctgagcccagtggccggatagtgaccgttctccctggactccccacatctcctgacagtgcttcatcagcttgtgggaacagttcagcaaccaaaccagacaaggatagcaaaaaagaaaaaaagggtttgttgaagttgctttctggcgcctccactaaacggaagccccgcgtgtctcctccagcatcgcccaccctagaagtggagctgggcagtgcagagcttcctctccagggagcggtggggcccgaactgccaccaggaggtggccatggcagggcaggctcctgccctgtggacggggacggaccggtcacgactgcagtggcaggagcagccctggcccaggatgcttttcataggaaggcaagttccctggactccgcagttcccatcgctccacctcctcgccaggcctgttcctccctgggtcctgtcttgaatgagtctagacctgtcgtttgtgaaaggcacagggtggtggtttcctatcctcctcagagtgaggcagaacttgaacttaaagaaggagatattgtgtttgttcataaaaaacgagaggatggctggttcaaaggcacattacaacgtaatgggaaaactggccttttcccaggaagctttgtggaaaacatatgaggagactgacactgaagaagcttaaaatcacttcacacaacaaagtagcacaaagcagtttaacagaaagagcacatttgtggacttccagatggtcaggagatgagcaaaggattggtatgtgactctgatgccccagcacagttaccccagcgagcagaatgaagaagatgtttgtgtgggttttgttagtctggattcggatgtataaggtgtgccttgtactgtctgatttactacacagagaaacttttttttttttttaagatatatgactaaaatggacaattgtttacaaggcttaactaatttatttgcttttttaaacttgaacttttcgtataatagatacgttctttggattatgattttaagaaattattaatttatgaaatgataggtaaggagaagctggattatctcctgttgagagcaagagattcgttttgacatagagtgaatgcattttcccctctcctcctccctgctaccattatattttggggttatgttttgcttctttaagatagaaatcccagttctctaatttggttttcttctttgggaaaccaaacatacaaatgaatcagtatcaattagggcctggggtagagagacagaaacttgagagaagagaagttagtgattccctctctttctagtttggtaggaatcaccctgaagacctagtcctcaatttaattgtgtgggtttttaattttcctagaatgaagtgactgaaacaatgagaaagaatacagcacaacccttgaacaaaatgtatttagaaatatatttagttttatagcagaagcagctcaattgtttggttggaaagtaggggaaattgaagttgtagtcactgtctgagaatggctatgaagcgtcatttcacattttaccccaactgacctgcatgcccaggacacaagtaaaacatttgtgagatagtggtggtaagtgatgcactcgtgttaagtcaaaggctataagaaacactgtgaaaagttcatattcatccattgtgattctttccccacgtcttgcatgtattactggattcccacagtaatatagactgtgcatggtgtgtatatttcattgcgatttcctgttaagatgagtttgtactcagaattgaccaattcaggaggtgtaaaaataaacagtgttctcttctctaccccaaagccactactgaccaaggtctcttcagtgcactcgctccctctctggctaaggcatgcattagccactacacaagtcattagtgaaagtggtcttttatgtcctcccagcagacagacatcaaggatgagttaaccaggagactactcctgtgactgtggagctctggaaggcttggtgggagtgaatttgcccacaccttacaattgtggcaggatccagaagagcctgtctttttatatccattccttgatgtcattggcctctcccaccgatttcattacggtgccacgcagtcatggatctgggtagtccggaaaacaaaaggagggaagacagcctggtaatgaataagatccttaccacagttttctcatgggaaatacataataaaccctttcatctttttttttttcctttaagaattaaaactgggaaatagaaacatgaactgaaaagtcttgcaatgacaagaggtttcatggtcttaaaaagatactttatgtggttgaagatgaaatcattcctaaattaaccttttttttaaaaaaaaacaatgtatattatgttcctgtgtgttgaatttaaaaaaaaaatactttacttggatattcatgtaatatataaaggtttggtgaaatgaactttagttaggaaaaagctggcatcagctttcatctgtgtaagttgacaccaatgtgtcataatattctttattttgggaaattagtgtattttataaaaattttaaaaagaaaaaagactactacaggttaagataatttttttacctgtcttttctccatattttaagctatgtgattgaagtacctctgttcatagtttcctggtataaagttggttaaaatttcatctgttaatagatcattaggtaatataatgtatgggttttctattggttttttgcagacagtagagggagattttgtaacaagggcttgttacacagtgatatggtaatgataaaattgcgatttatcactccttttcatgttaataatttgaggactggataaaaggtttcaagattaaaatttgatgttcaaacctttgt

SEQ ID NO: 568 - DNA, 1888 bp, Homo sapiens
gccgcccggcgcggagtggctgccctgcgcggggacacttagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggaattcaaacccattggtaccgcgcacaacagaagggcccagccttttgttgcagctgcaaacattgatgacaaaagacaggtagtgagcgcttcctataactcgccaattgggctctattcaactagcaatatacaagatgcgcttcacggacagctgcggggtctcattcctagctcacctcaaaagacgggaactactttgaacacaagcataatattcggcccaaacctttcgtgatcccgggccgaagcagtggatgcagcactccctccgggattgactgtggcagtggacgcagcaccccttcttctgtcagtactgttagtaccatttgcccaggtgacttgaaagttgcggctaagctggcccctaacattcctttggaaatggaacttcctggtgtgaagattgtacatgctcagtttaatacacctatgcagttgtactcagatgacaatattatggaaacactccagggtcaggtttcaacagccctaggggaaacacctttgatgagcgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggttcaggcggggcacagaggatgccgctctgtgacaaatgtgggagtggcatagtcggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaagattt

SEQ ID NO: 569 - DNA, 1714 bp, Homo sapiens
caggacgccgcccggcgcggagtggctgccctgcgcggggacacttagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggacgggaactactttgaacacaagcataatattcggcccaaacctttcgtgatcccgggccgaagcagtggatgcagcactccctccgggattgactgtggcagtggacgcagcaccccttcttctgtcagtactgttagtaccatttgcccaggtgacttgaaagttgcggctaagctggcccctaacattcctttggaaatggaacttcctggtgtgaagattgtacatgctcagtttaatacacctatgcagttgtactcagatgacaatattatggaaacactccagggtcaggtttcaacagccctaggggaaacacctttgatgagcgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggttcaggcggggcacagaggatgccgctctgtgacaaatgtgggagtggcatagtcggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaagatttaaaaaata

SEQ ID NO: 570 - DNA, 1672 bp, Homo sapiens
cgcttccaaagttggagctctccggggtgggagggggcggggaggacggcggggcggtgacgtcacccccagcggggataaagcgcccccgcccgggtcggggccaggacgccgcccggcgcggagtggctgccctgcgcggggacacttagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggaattcaaacccattggtaccgcgcacaacagaagggcccagccttttgttgcagctgcaaacattgatgacaaaagacaggtagtgagcgcttcctataactcgccaattgggctctattcaactagcaatatacaagatgcgcttcacggacagctgcggggtctcattcctagctcacctcaaaacgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggttcaggcggggcacagaggatgccgctctgtgacaaatgtgggagtggcatagtcggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaagatttaaaaaa

SEQ ID NO: 571 - DNA, 5996 bp, Homo sapiens
tccttttattgtggatgaacaccacgtacatgccgtaaatgctccctaggctggctgcggctacaaggcagacccgggagctgagaatagaggaatacctgcccaagcaactcattctgcacagcagccgacaagacagcgattttcctgtgctggaatgtgcccatccaaagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaaggtggggatgatagcaaaatatgtccatccctttgcagttactcagggctcaacggcaacccctccagtgagttagattactgtagcacttacagacagcacttggatgtccctcgggactcaccaagagccattagtttcaagaacggctggcaaatggcccggcaaaacgcagaaatctggagcagcacggaagaaaccgtctctcccaaaatcaaatcccggagctgtgacgatctcctaaacgacgactgcgatagcttcccggacccgaaagtcaagtcggaaagcatgggctccctgttatgtgaggaggactccaaggagagctgccccatggcgtgggggtccccctacgtcccggaggttcgcagtaacggcagatcaaggatcagacacaggtcagcccgcaacgccccggggttcctgaagatgtacaagaaaatgcaccgcatcaaccgcaaggacctgatgaactccgaggtgatctgctccgtgaagtccaggattctgcagtacgagagcgagcagcagcacaaggacctgctgcgcgcctggagccagtgctccacggaggaggtgccccgggacatggtgcccacacgcatctccgaattcgaaaagctgatccagaagtccaaatccatgccaaatttaggggatgacatgctgtctcccgtaaccctagaaccaccgcaaaatggcctatgtcccaagaggcggttttccattgagtatttgctggaggaagaaaatcaaagcggcccccccgctcggggccggcgaggctgccagtctaacgccctggtgcccattcacattgaagtcaccagcgatgagcagccccgagcacacgtggagttttccgacagcgaccaggacggggttgtgtccgaccacagtgactacattcacctagaggggtcatccttctgcagtgaaagtgactttgatcacttttccttcacatcctccgaaagcttttacggatccagccaccaccaccaccatcaccaccaccaccaccaccgccacctcatcagctcctgcaaaggcaggtgcccggcctcctacactcgatttaccacaatgttaaaacacgaaagagccagacacgaaaacaccgaggagcccagaaggcaagaaatggaccctggcctttctaaacttgcttttctagtcagtcctgtgcctttccggaggaaaaaaaattcggctcctaagaaacagactgaaaaggcaaaatgtaaagcatctgtgtttgaggctctggactctgcccttaaagacatctgtgaccaaattaaagctgaaaagaaaagggggagcttgccggacaacagcatcctgcaccgcctcatcagtgagctgctgccagatgttcccgagaggaactcatccctgagagcgctgaggaggagccccctgcaccagcctctccacccactgcctcccgatggtgctattcattgtccaccctaccagaatgactgcgggagaatgccccgcagtgcctctttccaagacgtggacacagccaacagcagctgccaccaccaagaccgtggcggtgcactccaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatggttcacagtgcctgaattacacctgctccgaaaactagctttgtatttcttatgactttgcataagaactgttcatctttggatcttgagcaccttacagataaaactttttatggcatctctttcatggacagtgatattgatcttttcacaatgtacgtagcctctagaattttgtacatatgtttgctctttttttgtacagactagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtatacttcagtttttcttcttgacatttatctttataaaaattgtgtattttattccaacttgttaaactaagagaaaatgca

SEQ ID NO: 572 - DNA, 5720 bp, Homo sapiens
caaaaccacctgtcgctcccaagccaaagactaccagtccactgacgccagtgaccgcgcccaaattcccttcctcagccaggcccgagagtcttcacagtccaaactccatgttcaggggtccgaagccccccattgcccccaagcccaggctgactgccccaaacgagtggagagccagtgtgtacctgaatgacagcttgaacaaatgcagcaacgggcggctgccctgtgtagacagggggcttgatgaggggccccggtccatcccaaagtgctctgagtcggagaccgacgaggattacatcgtggtccccagggttccgctgagggaggatgaacccaaggacgagggcagtgtggggaacaaagccctggtgtctcccgagtcctctgcggaagaggaagaggagcgtgaagagggaggcgaggcatgtggcctggagggtacaggagctggtgaggattcagtggcccctgctgctccgggtgcaggagcgctgagcagggagggtgaggaaggcacagaccttgctcttgaggatgaaggggagggctgcgctgatgagccagggacactggagcaggtgtccagaagtgaggaggaagagaagctagtgcagccacacagggagtgcagcctggaggacagtgggccttgggctggagagggggtcttccagagcgacctcctcctgcctcacatccatggagaggaccaggagccccccgacacccccggggaggcagaggaggatgatgaggaaggctgtgccagcacagacccagcaggggcagatgagggttcgggtcctgacaggcccacggaggacatgggacaggatgctgaggacaccagtgaggagccccctgagaaggaggagctggccggggtccaggaggcagagacagccacagactgccctgaagttcttgaggagggatgtgaagaggccacgggtgtcacaggtggggaacaggttgacctcagtgaaccacctgaccacgagaagaaaaccaaccaagaagtggcagccgccaccctggaggaccatgcacaggatgagtccgccgaggagagctgccagattgtcccttttgagaatgactgcatggaggacttcgtgacttccctcacaggaagcccctatgagttcttcccaactgagagcacctctttttgcagcgagagctgttctcctctttctgaatcagcgaaaggtttagaatcagagcaggcaccaaagctggggctgcgtgcggaggagaaccccatggtgggggctttgtgtggccagtgtggctccctacagggtggagcggccgagggtcccgcagcccctgatgtggtggtcgtgctggaggaggaggccttggatgatgcactggccaacccctatgtgatgggagtgggcctgcccggtcaggcggcccctggagaaggagggcaggctgcatcggacgccctgggtggttatggctcgaaagaagaattgaactgtgaggcagagggtggcctggttcccgcggacaggaagaacaccagcacgagggtccggccccactctgggaaggtggccggctatgtcccagaaaccgtccctgaagaaaccggacctgaggcgggctcgtcagcccctggcattggaggtgccgcagaggaggtgggaaagacgcttttgtcattggaggggaagcccttggaagccagcagggccttgccagcaaagcccagggcctttactttataccctcggtcgttctccgtggaaggccgagagattccagtgtccgtgtaccaggagcctgaggggtcagggttggatgaccacaggataaagaggaaagaggacaatctctctctgtcgtgtgtaattggctcctctgggagtttctcccagagaaaccaccttccgtccagcggcacctccacgccttcttccatggtcgacatcccacctcctttcgacctggcctgcatcaccaagaagcccatcacaaagagctctccctcactcctgatcgagagcgactccccggacaagtacaagaagaagaagtcatcctttaagcgcttcctggcactgacgtttaagaagaagacggagaacaaattgcatgtggatgtgaacgtgtcttcctctaggtcctcttcagagtccagctaccacgggccttccaggattctggaagttgaccggagaagcctcagcaactcccctcagcttaagtctcggactgggaagctccgggcttctgaatccccctcctccctcatcttttatagagatggcaagaggaaaggtgtccccttcagcaggacggtgtccagagtggagtcctttgaagaccgctcccggccgcccttcctgcccttgccactgaccaagccacggtccatctccttccccagcgctgacacttcagactatgagaacattccagccatgaactcggactatgagaatatccagattccaccccggagacctgccagggctggcgcgttcacgaagctgtttgaagatcagagcagagccctgtccacagcaaacgaaaatgatggctacgtggacatgagcagcttcaacgcctttgagagcaaacagcagagtgcagaccaggacgcagaaagcgcctacacagagccctacaaagtctgtcccatctcgtcggcagcccccaaagaggaccttacgtcggatgaagagcagagaagctcggaggaggaggacagtgcttcaagagaccccagtgtcacccacaaggtggaaggacagtccagagcccttgtcatcgcacaggaactgctatcttcagagaaagcatacgtggagatgctccagcacttaaatctggatttccatggagctgtcatgagggccttggatgacatggaccatgaaggcagagacacattggcccgggaggagctgaggcagggcctgagtgaactcccagccatccacgaccttcatcaaggcatcctggaggagctggaggaaaggctgtcaaattgggagagccagcagaaggtagctgacgtcttcctggcccgggagcaggggtttgatcaccacgccactcacatcctgcagttcgacaggtacctaggtctgctcagtgagaattgcctccactctccccggctggcagctgctgtccgtgaatttgagcagagtgtacaaggaggcagccagactgcgaagcatcggctgctgcgggtggttcaacgcctcttccagtaccaagtgctcctcacagactatttaaacaacctttgtccggactccgccgagtacgacaacacacagggtgcactgagcctcatctccaaagtcacagaccgtgccaacgacagcatggagcaaggggaaaacctgcagaagctggtccacattgagcacagcgtccggggccaaggggatctcctccagccaggaagggagtttctgaaggaagggacgctgatgaaagtaacagggaaaaacagacggccccggcacctatttctgatgaacgatgtgctcctgtacacctatccccagaaggatgggaagtaccggctgaagaacacattggctgtggccaacatgaaggtcagccgccctgtgatggagaaagtgccctacgctctaaagattgagacttccgagtcctgcctgatgctgtctgcgagctcctgtgcagagagggacgagtggtatggctgtctgagcagagccctccctgaggactacaaggcccaggcgctggctgcattccaccatagcgtggagatacgagagaggctgggggttagccttggggagaggccccccaccctggtgcctgtcacacacgtcatgatgtgcatgaactgcggctgcgacttctccctcaccctgcggcgtcatcactgtcacgcctgtggcaagatcgtgtgccggaactgttcgcggaacaagtacccgctgaagtacctgaaggacaggatggccaaggtctgcgacggctgcttcggggagctgaagaagcggggcagggctgtcccgggcctgatgagagagcggcctgtgagcatgagcttcccgctgtcttcaccccgcttctcgggcagtgccttttcatccgtcttccagagcattaacccctcgaccttcaagaagcagaagaaagtcccttcagccctgacagaggtggctgcctctggagagggctctgccatcagtggctatctcagccggtgtaagaggggcaagcggcactggaagaagctctggtttgtcatcaaaggcaaagttctctacacctacatggccagtgaggacaaagtggccttggagagtatgcctctgctaggcttcaccattgctccagaaaaggaagagggcagcagtgaagtaggacctatttttcacctttaccacaagaaaaccctattttatagcttcaaagcagaagataccaattcagctcagaggtggatcgaggccatggaagatgcgagtgtgttatagcagttatcaagcatgtggacttgtaacaaattcttaggtcaatatgtgaatgcttttagaagctaagctgtggctcaactcatccggacacacacctggattcagcaatgaggcctgaccttttttgctataaccgccccaccactcccctgcccttgccaacatcttcatgaatggaatccttaagggatatttatggacctctccttttctgtgttttccacccctacccccacccgccacccagtaataaactatttccttaccccgcagtgagttaaaatttagtaagatgaagatgtggaaaccaatgaaaagtacatttagaaatgcaggctttttagtagaaagaagctcttacagtttttactcatgataaatcttatcacctttcaaaaattgattgtggtgcctcaggtgaaatgagaagctatcagtaacagctactctcatcgaaagcactttattattttacggagctgcaacctccaattttgtgttttctaagtgatttacttaagtcaataacagatggaatcctgtggactaatgtgccaccagttttctaacaagggtgtacataaaatggatttgtgcagacctggctgtggcttgctggtgtgcaagcacacatcactttagaggggctgcgccccaccagataggaaggggaggattttctcctccagtcgaccttgtgacctgtatactaacataacttattaaaggaggggtccctcctcccccagagcagtcctcaacactatgtcagtgctggaaatgcagccactggcagatctggccccccagacgtcaccgcagggcctctgaagagtcaaggtctgctttaatttattgtgtgcctttctgtgtttacctcactcaagctgacaacattgtttatgggaatctatccttcttttagacacacggtaatccttgggctgtattactgaaggctttttattttttgagaggtgaaaaaaagagaaaacaagttagactccaaaggtgaattcctggtcttggcagatggctctgggaacagcgagggagcacagaagtcgtggcctgaggctgttctatgggcacttggggctaaatcgcctcctgagggtgactgttgcttattctgctggacaggtttttacataaagcaaagggcatgtgaggggtgggattccttgttactcttactgcaataaaaatcaattgtttgat

SEQ ID NO: 573 - DNA, 2905 bp, Homo sapiens
gatgacgcaaaccgggaacagcggctgagcctgcgcttcggaagcatggatgtgcgcctgcgctgcgctagggcgcggcgggcggtttgaattttgcttacagagtcccgtctcaccatcctgggcttccaacggagactgcggtatccgcagctggagacccagcggcgagtagccttttgctcccggacggacttgagaggcttaaaggatggcctcgtcagatctggaacaattatgctctcatgttaatgaaaagattggcaatattaagaaaaccttatcattaagaaactgtggccaggaacctaccttgaaaactgtattaaataaaataggagatgagatcattgtaataaatgaacttctaaataaattggaattggaaattcagtatcaagaacaaaccaacaattcactcaaggaactctgtgaatctcttgaagaagattacaaagacatagaacatcttaaagaaaacgttccttcccatttgcctcaagtaacagtaacccagagctgtgttaagggatcagatcttgatcctgaagaaccaatcaaagttgaagaacctgaacccgtaaagaagcctcccaaagagcaaagaagtattaaggaaatgccatttataacttgtgatgagttcaatggtgttccttcgtacatgaaatcccgcttaacctataatcaaattaatgatgttattaaagaaatcaacaaggcagtaattagtaaatataaaatcctacatcagccaaaaaagtctatgaattctgtgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtgaacttttgaacataccaacagggtatagagtatagaggctatttctataattttcttatatataatttttttaacttttaatcttttttgtttccttttttttttttttgagacaggatcttgctttgtcacccaggggcttgctttgtcacgcaggctagagtgcagtggcgcaaacatggctcactgcagcctcaacctcccaggctcaagtgatcctcccacctcagccccctgaatggctgggactacaagcgtgcgccaccatgcctggctaatttttgtattttttggagagatggggtttcaccatgttgcctaggctggtcttgagctcctgagctcaaacaatccaccctcctcagcctcccaaagtgctgggattacaggcttgagccaccacacctgacctattcttgtttcttataaaaataaaacttttttggataaagcttatttcttgtttttttctttttctttttttttttttttgagacagtctcgctctttcacccaggccggactgcagcggcgctatctcggctcactgcaaactctgcctcccaggttcacgccatcctcctgcctcagcctcctgagtagctgggactacaggcacctgccaccacgcccagctaattttttgtatttttagtagagatggggtttcaccgtgttagccaggatggtctcgatctcctgacctcatgatccgcccacctcggcctcccaaagtgctgggattacaggcgtgagccaccgcgcccggccaacttatatattttcaagattcacctcctctcaccaaatatttaactacctgctgaatacgcctctgtactaggcacataatggaactaaaaaatgctcatgtccagtttttgtgttgagtgaacaatgctgcagaccctaataagattgggtacagatcggcatgcgcctgtagtcccagctactcaggagaattgcttgaacctaggaggtggaggttgcagtgagccgagatcgtgccactgcactccagtctgggcaacagagcgagactccatctcagaaaaaaagaaaaaaagactgggtacagatgtgatattggaagaaaaagatcaagctgatgaggttaggatacccaggccctttggacttaaagatcactagtgtctaaattccatcgatggcatttcagtctataggtaaacttcctggaagctggatttggagacagtttatcatctgattattgggctttcgtataggtccttagggagcagcttacctgaaatgcatttagtgtacaccagtctgtaaacttcaacctgtaatgaaagtgtaataaatgtacattgagttgatgtgataatgtgatataataagaaatatatatttgatcttcctatctagttccttgttcagagctcctaaaacccttgtaatttccaaagtgatggagtacatcttttgttctagtatttggtctttgaccccagttcctgacacaaagctcctaaattcctttaaatttcccagtgataggagaattttttgttctaatgaggtcactcttgatgggcacctggataactcaggatgggggctgctcacaaagaccacatcatgattggaagtttcaaactttcagtctcccacctccagagaggggagaggggctggagatttgtgtcaataatccatcaggcctatgtcaacaagacataatccgttaactatggagttcagggagcttcagggttggcaaacattttgatgtgccaggaaggtgacgcactccagctttatgaagtcagcaagtcctgtgctcaggatgcttctggaccttgccccaggtaccccttcatgtggctgttgttcatctgtatcctttgtagtagccttaaaataaactgttaaacacaagtaaa

SEQ ID NO: 574 - DNA, 5526 bp, Homo sapiens
ctcctccgccccgcgcgccgtccctgcgccccgctccgcccgcgcctctctcccagcgccgcgcctcgggcgtaaagagcgcgcccctcgcaccgcagccagtgccgaccgcagcagcccagccccagccttcctccgcctccgcctctctctcctcctcctcctccgccgccggacacgcagccgcaggccgggaccgggacgcagctggggagtcagggacgcgcgcagccagcccttccccctccggctcccgcaccgccggccgcctcccctcgccctcctactctcccctccctgctccttcgctttttcctcctcctcctctcccggccccggctgccagcaccatgtccgcagggggagattttgggaatccactgagaaaattcaagttggtgttcttgggggagcagagcgtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataaccatcgaggagggggagcagcgcgccaaagaactgagcgtcatgttcattgagaccagtgcgaagactggctacaacgtgaagcagctttttcgacgtgtggcgtcggctctacccggaatggagaatgtccaggagaaaagcaaagaagggatgatcgacatcaagctggacaaaccccaggagcccccggccagcgagggcggctgctcctgctaatgcagagccgacctgtggcttcccatgacactccttgcttgttgtgttgcttcctattggctagcttcctaaggggggagggaaccgagttatcaagatgggaggatttttcttttctctctgtctttaggagtagggtgggatggggagggaggctgggcatcagggatcacatcactcttaacggctgttacttaaacaactattttttggtttggttgtaatatattgtactttattaagattgccaaaaactgttaaaatttaaaaaaaatttaaatcatgtgtatacaattttttgccagataaaaatgtagtcatttttatttgaaagatgtgctttttgtttttgtatatttgtaaacttatagagaaccttttccacacacctcctccttcctgttctctttgaaccattcatcacctctgccttcctcctatccccagcccaataaattaaaacaattaactgagcaaattaattaggcttcagtctggggccatctggccccactctctaggccctactccagttaaatcaaacattggttgaacacatcagcctctgaaaaggtagctctgactcttgtctttccatggccagagtgggtcgtcaacctcgtgtggagctgagaccaaggtctgtgggctctaggcagcccggcagcagcccccagaggaactgctcccacctctccttctctttccctgaaaagccttgaagggggttgagggtacaggcaaccttgtgttctctgtgccctcagggactggcagagcaagaggccatcagaaggacgaggtgctgttggcaattgcagctgcgtggtgcgtggtttatagactggggtgccatgtgtacttctgaaaatattttaaccagcccacccagcagtcagtacacatgcctgggccaagtctaagaaactcagtgtgtgatgttgggcagtgtgccatcctgaagccttcctcctggatgtcagggaagctggaccacctggagttgatcctctgtgatggggaggcgggggggggggggggtgttgtctgcagaaccaccaccttgaaagatccatgttcttagagcctcagctgctaatattgttgagtgctttctggaaaagctgatttgttgctatgttttcaccccagtggcatggcgcagttgaagtctttgtggacatatctttgtggctactgtggctgcgctgtggtcacctgaggatgtggttcaggtggggtctccagaaggctgcttgcccccagagagccatctcttccatttttgattcattcctgagaatggcttagtcctgagaatctgcaaagtctctgaagagaactctctcttcccactaagtgatataacctacttggccagcattccaaatagactcagactcactgccctgagcctgcacagagccaggtgcaatgggcagtgagtctggccaaaatgtaaaccccaccctccctgctgtcattggctctccctccaggctgctgctgggcatgtcatagatgggatgaatgaccatctggggtatggtgggctgaactccacaaggtcgttggaatgaattttgaaacttctcagaaattaatctgaaatggcaggcagtaagtgcagcagaatctggcaggactgatatttgtgcagtgggcctgccacacaccctctgcctaggaggctgtatgccagagctcatctctagcaaggaatttatcttcaggtgaagaagagaggaagcaggatcccactgagcacctcttgcagaaggcaaggaccaatgtttgaacgtgtttcagatgtcatgtgtttagtttttatatgtgtgtacataattatatatagagatagacttgtgtatacaccttccacaaacacatcctcacggagatacatgtgctcaatgtatattcttgtttctcctgctctcaagttggaacttgcattgtgataagttttggaaattcaaaagtactgcaacgtgttgaaataagaaatacttaatattgtcaaataacttgtgattgtcttgccatcaataaaataatgcatagttgtgttaaactacaggcaaacatagcccacgggaatatctccaccatttctctatgtactttatatgcacgggtgtgcatgcctgtgtgggccagtgtccccccaccatgggcacacccccaagtggtgcttgttggaagagtgcttacttacctcgagagaatttacaggagtccacatgacagtgtcctgcctggttggcagcgggggccatcacctgtggcctctgagaccgccccatttacaggaatctgcactgggtctcagtgaatgaacgtatggtagatttttattttcttggcactaaagattagcttttttaaaaaaacatcccataaaacagtagaaactcagttcccttctcaggggcacacacatccaaggcaccgtggactgtgtttccatcctggcctagaggagcagtaaaagatagcatttggtttgacatggccttagtgagtcctgcctttcctagcatgcacacaacatcctctctttgagtttgggttctccccagccccttggcctctgaggctgagggtggcttcctcccatcctcccatctcagtggttccatggcgctcccttcggcacgtgcggtttccgcccctcccttcctggggtgtggaaaggcagccagacctctttttcagaagttgttggttccctgatttttgtcttgagcaggcaccatccctgtccccttgcttgcaggtagaattggcacagagttaaggttccataataaactgttaggtgctcttgaagaagatgtcatggcattgcctcagcaccccagcaagagcattgcatctttgctgaatccagatgggttagcagagggcaaattggaggattcctttgaggaaatgttctcaattgagcaattcagtccctctccccaaagactagacgtgacctggcagattagcaggatcctcttggccttcttttttggggatggtgggagtgaagggggtgaatcttaaaagcttatcaacaaagctcctgttctgcaggcatcaggaaagttgagtgtaagatggaaaaagcaaacagcctatttacaagtggaaacacattggttctgatcactcctaacttgctgggtgatcatacatacatcaacatgaaggtgtgacatcagaatcatgagcaccatggctgcagttgtgtgatccaaggctagttggcttggtagctgttggcagcagtttcccttggtcagaggcctccttgctatctatcgctgctctcttcttgtcatccttaaacattcagtcatgttcccaggtctgaggggagcaatggccagaccagtttcagtatctctggcaacagaaacaaggattgaaatggtggtagttaagagtgcagacacatctggggtgcaacgtctgcatcatcctggtggctagccagtgcggggaggccctgccctgggataccagttgtgacaataaagggatggccctcctggcttcagcatcctgcaggtagagcagcctcattccttcacaagatggaaggcaggtgaggatgtcaggatgagatgggaccaggtagccgaggacagtgaggcatgtctgagccacttgaggggcagctgaacagaaggatgtctgtgtgcatcaaccgagcagattgtgcgcacactcgtttccgaactgcctctccccaaagaatgtgaggcattgtcaccttgttacagctatgtgaagcagagctgtcacaacttttcctgtctacaggcaggaaaaccaggatggagaagggcaacttgcttattaagatcacccagcaagttaggagtgatcagaaccagtgaagtttccatttttcatccattgctgccctgtgtgtgaacaaatgtgactccatatttattacacagcaaggactgctgtgtgtgggtgtgttcctcagaccatctctactctttttggttaggacactaggttcttcccagcatatgagtgagaatattggtggtattttgggctcctctactgcacaagggccagtccccaagtctactctgattgattgtcatgggcacccacacagatcaggacaccctttgaatttttgtttgacatgaactatttaggtgttccaaaaccttgggatctcaatgtgcaaactccttggactccagacccctgtctggttggcactcccagcagtgtgtggtttcatcaggaaatccttgcagcaggggtttagatggttccttcaggaggtgggaagcctccatagcattgaaggccagcctgcatctcgcggtgtgtgtccacttctcccctcactttcccctcacccatccctttaaagtgattggctgtgaggagcacagagggtggcaattccatctgttatgggctcagaagacatagccgccatgttgatttcacattaaactgtgtaaaatgtggaaaagactcagcatgttggtcaaacaataaactgtcctaattctcaaaa

SEQ ID NO: 575 - DNA, 3973 bp, Homo sapiens
aagcagcccgcggaccggcagcaaaggaacgtgcgaacgcgtgacgccgcccgactggctcgcgctctcccgtgccccggcgtcctccgcccgctcatggcccgggccgccgcggacgagcggcgctgaggcgggccgcgtggagacgtgaggcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaagcaccagcagacgtttttgaatcaactgagagaaattacggggattaatgacacccagatactacagcaagccttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaaatgtgattgatctcactggagatgataaagatgatcttcagagagcaattgccttgagtttggccgaatcaaacagggcattcagggagactggaataactgatgaggaacaagccattagcagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcagtcattatttaatcttttggaatttagaagattagttctgaattacaagcctccatcaaatgctcaagatttaccccgaaaccaaaaggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcagcaagatgtgagtgagtttacacacaaattattagattggttagaagatgccttccaaatgaaagctgaagaggagacggatgaagagaagccaaagaaccccatggtagagttgttctatggcagattcctggctgtgggagtacttgaaggtaaaaaatttgaaaacactgaaatgtttggtcagtacccacttcaggtcaatgggttcaaagatctgcatgagtgcctagaagctgcaatgattgaaggagaaattgagtctttacattcagagaattcaggaaaatcaggccaagagcattggtttactgaattaccacctgtgttaacatttgaattgtcaagatttgaatttaatcaggcattgggaagaccagaaaaaattcacaacaaattagaatttccccaagttttatatttggacagatacatgcacagaaacagagaaataacaagaattaagagggaagagatcaagagactgaaagattacctcacggtattacaacaaaggctagaaagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagagatttgcaggaaagcatatccagaatccatcgaacaattgaattaatgtactctgacaaatctatgatacaagttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctaccta

SEQ ID NO: 576 - DNA, 5216 bp, Homo sapiens
aagcagcccgcggaccggcagcaaaggaacgtgcgaacgcgtgacgccgcccgactggctcgcgctctcccgtgccccggcgtcctccgcccgctcatggcccgggccgccgcggacgagcggcgctgaggcgggccgcgtggagacgtgaggcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaagcaccagcagacgtttttgaatcaactgagagaaattacggggattaatgacacccagatactacagcaagccttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaaatgtgattgatctcactggagatgataaagatgatcttcagagagcaattgccttgagtttggccgaatcaaacagggcattcagggagactggaataactgatgaggaacaagccattagcagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcagtcattatttaatcttttggaatttagaagattagttctgaattacaagcctccatcaaatgctcaagatttaccccgaaaccaaaaggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcagcaagatgtgagtgagtttacacacaaattattagattggttagaagatgccttccaaatgaaagctgaagaggagacggatgaagagaagccaaagaaccccatggtagagttgttctatggcagattcctggctgtgggagtacttgaaggtaaaaaatttgaaaacactgaaatgtttggtcagtacccacttcaggtcaatgggttcaaagatctgcatgagtgcctagaagctgcaatgattgaaggagaaattgagtctttacattcagagaattcaggaaaatcaggccaagagcattggtttactgaattaccacctgtgttaacatttgaattgtcaagatttgaatttaatcaggcattgggaagaccagaaaaaattcacaacaaattagaatttccccaagttttatatttggacagatacatgcacagaaacagagaaataacaagaattaagagggaagagatcaagagactgaaagattacctcacggtattacaacaaaggctagaaagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagagatttgcaggaaagcatatccagaatccatcgaacaattgaattaatgtactctgacaaatctatgatacaagttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcgatcatgatgacaccgaacatgcaaggtattatcatggcgataggtaaatccaggagtgtatatgacaggtgtggccctgaagcagggttctttaaggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctacctatgtgtttgtaagcaggtatattgtatattagtgtattagtaatactagataaatgaattttgtctggggattaagattggatagttaatagattaatacaatcttttaattctgctctaatgctagcaaattggaaaatgtttaagtctttgacacttaaatttatctatatttttaacaaagttcttgaacttagtatggcaccggaacctgttttgaattcagtcaggtttttactcaagtaagtggttgattttttttaagtcaaactacactgaaacttttatccttttcttagattaatcttactttttaaatgtatttacaatatacagcaaggtgattatttcaagagaatcccaaagtacttgaataagggctattgtaaaatttaaaagaaatatttatatatacacatatatacacatacacacatgtatatatatattcttcataatggaggacaatgttttgcaatatataaatcattctatttttgtaaattgtatatcactttaattgaaaatgttctctactaattaatactgtgaaacaaaattgatgttgtttaactagaagttatgagtatcttaactgcctttattccttttcaaaaaggaaaaagctgtagaacattttgtagatgaaactactgtttaagattaatgaattaatattgtgaatgaaaatcaaaatccatactttaaaggtaatcatgttactaacaacctatttttgaattcataaaaatttctttataaatgatgttttgtgaacatagtaaaatagaccattatactatgtgtatgtttgatacagcgtcgccaaaactagtgttctttattagtgcctctcacaaaagatcctggatggaggagtaagatgaaatattatgctattatatgatgctgtttgtaaaggtattaatgtactagtaaggtgttaatgacaaggaattagtactattcctgttgtaaagttagattttgcatattgtatctatcaaaatatgtttgggtttagattttaagttgtctactgagcagatttctgcattggttttccagtcctgttaaaagtttagaaacttcatatgtgtcatcacagcttttgtaaagaaagtatccttaatattttatgacattct

SEQ ID NO: 577 - DNA, 6354 bp, Homo sapiens
aggcgggtctgaggtttggtgactgcggggcaggccgggggcagctgtctgtctggctctttttgacagcccccagtgcgaaaggctgccagcatgtcatcagtgagccccatccagatccccagtcgcctcccgctgctgctcacccacgagggcgtcctgctgcccggctccaccatgcgcaccagcgtggactcggcccgcaacctgcagctggtgcggagccgccttctgaagggcacgtcgctgcaaagcaccatcctgggcgtcatccccaacacgcctgaccccgccagcgacgcgcaggacctgccgccgctgcacaggattggcacagctgcactggccgttcaggttgtgggcagtaactggcccaagccccactacactctgttgattacaggcctatgccgtttccagattgtacaggtcttaaaagagaagccatatcccattgctgaagtggagcagttggaccgacttgaggagtttcccaacacctgtaaaatgagggaggagctaggagaactatcagagcagttttacaaatatgcagtacaattggttgaaatgttggatatgtctgtccctgcagttgctaaattgagacgtcttttagatagtcttccaagggaagctttaccagacatcttgacatcaattatccgaacaagcaacaaagagaaactccagattttagatgctgtgagcctagaggagcggttcaagatgactataccactgcttgtcagacaaattgaaggcctgaaattgcttcaaaaaaccagaaaacccaagcaagatgatgataagagggttatagcaatacgccctattaggagaattacacatatctcaggtactttagaagatgaagatgaagatgaagataatgatgacattgtcatgctagagaaaaaaatacgaacatctagtatgccagagcaggcccataaagtctgtgtcaaagagataaagagactcaaaaaaatgcctcagtcaatgccagaatatgctctgactagaaattatttggaacttatggtagaacttccttggaacaaaagtacaactgaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgaggtgttggatcctgaacaaaaccataacttcacagatcattatctaaatgtggcctttgacctttctcaagttctttttatagctactgccaacaccactgctaccattccagctgccttgttggacagaatggagatcattcaggttccaggttatacacaggaggagaagatagagattgcccataggcacttgatccccaagcagctggaacaacatgggctgactccacagcagattcagataccccaggtcaccactcttgacatcatcaccaggtataccagagaggcaggggttcgttctctggatagaaaacttggggccatttgccgagctgtggccgtgaaggtggcagaaggacagcataaggaagccaagttggaccgttctgatgtgactgagagagaaggttgcagagaacacatcttagaagatgaaaaacctgaatctatcagtgacactactgacttggctctaccacctgaaatgccgattttgattgatttccatgctctgaaagacatccttgggcccccgatgtatgaaatggaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatgcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggtactgacacagttgattttattcacaccattaggggtatgcaagatgtccctgttttataaacataatcacaacagtaataaacctcaagtagtggctagtgtttagtatagaaatataagatgttgatttagtaaactgataaaaatcgaattcttgtctttttagtgggatccttactgtccctggaaagatatagcatagtggttctcagcacagtctccagaacagaagcatctgtagtacctggtaacttgttagaaatgtacattctcaggctccacagcaggccgcctgaatcaaatcctgggaggtggggacagaaatctgtgttttaagaagccttccaggtaattctgctgcacactcaagttcaggaaccaccggtatagaccattaccttagtggatttacctgtagagtttattggatcctgaaaccaatcaattacttagaactaggcaaagatgaaagtatagccaactattcttggctatatatatatattcaagtgggccgggcgtgatggctcacacctgtaattccagcactttgggaggtcgaggtaggcagatcaccgagcccaagagttcaagacaatcctggccaacggcgaaactctgtctctacaaaaaatatacaggcgtgttagcatgtgcctgtaatcccagcttcttgggaagctgaggcacaagaattgcctgaacccaggaggtggaggttgcagtgagctgggatcgcgccattgcactccagcctggctgacagagcgagactgtctctaaaaaaaaaagactcaagtggaccctacaatgaagcctacacatcccaatagaagccccttcttatgctgagggaagcagccctcagaacatgatagcttgtatccagcagagtggcacgtgctggcacacctcacagaagcaccctggccctggatgcctgcaacctcagaagagtgcagctcccagagggaggcagccatccatctgggatggtcctaagcatggaatcctaactcctgattccgtctcctatttcttgcttggctacgccagttcccaaatctggtagatgtccatgcccatgtgctcctgctgggactcaattcaggctatgtatgactatgaagtcaggctcatctgcttactggctgtgtgaactttttgtatcttggttttcttcatccatgaaatccaagtaatactacctaattgttactgtggagattaagttcaaatgcaatgtatagtaatattaagcaatttctagttattattctagccagtaatggacttcagaatcttttattacacaatataagaatatgtatgtaaagacattttggaatttcctggatgagaaggaagtctgggctgggcatggtggctcacgcctgtaaccctagcactttaggaaatcgaggcgagtggatcacttaagctcaggagttcaaggccagcctgggcaacatggcaaaaccccatttctacaaaaaatacaaaaattagctgggcatggtggcacccgcctgtagtccagctacttgaggctgagatgggaggatgagggaggtcggggctgcagtgagccaagatcacgccactgcactccagcaccctgggcgacagagtgagaccctgtctcaaaaaaaaaaaaaaaaaaaaagattgggccaaaatactgtgataaaatagcaggcctgctgataaaagtttatctgaatgcattgagaggaaaagtccagacctaggactagttatggcagttggagagaaagaacatcgggatgtttgaaaatatgccattgactatcttaactactgtaattttatcatttccaacgtcatctaactggggactagaacaaactgtgaattcactttcagcaaccagagggcgctaatccacacccacatcgctctgccctgttccacccagcaggggcaacaaggatataacttggggttctcggtattcttcctttagtcctgacacaggcagccttgcactttgtagcagcaggagggcacttgctttaagcatatctttcgaaaggcatccattgagagaataatgcattctccccttgctgtgtatgacatggaacagtatgaccattgcactagctttgtttttggtttgttttgttttttttttaattccaggggtgggaggttggttggttgaagtctaagctcttcctttttcacctgggttttttttttttggggggggtggggggttaggggtggggcgggtggggaagagccaaaattttaaccatttttaagcatataatttgggggtatcagttactggatctaagcatgtccactctacacgctttttttttttttttttttttttttttttgagatggagtcttgctctgttacccaggctgcactgcagtggcatgatctcggctcactgcaacctctgcctccccagttcaagcaattctcatgcctcagcctcccaagtagctgggaccacaggtgtgtgccaccacgcccagctaatttttgtattttttagtagagacagggtttcaccatgttggccaggctggtctcaaactcccaacctcaaatgatccggccaccttggcctcccaaaatgctggcattacaggcgtgagccaccacacccggcttacatgcattttttatcaccacaaactgaaactctgtacccactgaaaaagagctccaaattccaccctcaccccagaccctggtaaccactatttcactttctttctgaatttcccttcatatgagtgggatcaaacaagagttgtccttttgtgtttagcattcttacttagcaagccatcaactgctcgaacagtcactggggcaactacttttcgcccagtgtcctccagaaaagaaagatctggagggtcaggccactctttttcttcaaaataatggggtgcagaagggtagggatgaacctcttcctcctttgccactttagctttagctcaaaggaactccaactttttattatttgcaacagttagctttctttgtttcacatctctgccttgcagaaccatgacctatcaaggtgttttgtcaaacaaaaactaatactttccctgggaaaaagccatgtggtagcaagtaccagaaatttttatggccaaataatacaccactatatccatagaccgcatttggtttatccactcatctgctgattgtttccccctcttgggtattatgagtaatgctatgaacatgggtgtacacatctctcttgaagtcccttcttaggtcctttagggatacatatccaggagcagaactactagatcacatatgctaaggtctgaatgtccccccaccaaattcgtatgttgaagcaaccaccaacgtgataggtgaggctttaggaggtgattatgtcatgagagctccatcctcattaatggatttagtgcctttataaaggggctcaagggaaccaattacctcctttttgcccttcgattcccttccaccatatgaggacacagcaacaggccccgtcctagaagctgagactgggccctcaatagatgataccagtctgccagcacgctgatcgtgggcttctcagtcttcacaactatgagaaataaattcgtacttttaaatta

SEQ ID NO: 578 - DNA, 1286 bp, Homo sapiens
caccaccgcccctgccgccatcgccacctccgccgctgccgccttggggccctcctccttcaccgcccccttcaccacctctacacgttctaggccttctgtcctggagaagaagctatagtcgttctcccttgtgggcccggggcgcagccatggcggacggcggcggcggcgggggaactggcgcggtgggcggcggcggaactagccaggcctctgccggggcagcgactggcgctactggggccagcgggggcggtggccccatcaacccggcctcgctgcctcccggcgacccgcagctcatcgctctcatcgtggagcagctcaagagccggggcctttttgacagcttccgccgggactgcctggccgacgtggacaccaagccagcttaccaaaacctgaggcagaaagtggataattttgtgtcaacacatctggacaagcaggaatggaatcctacgatgaacaaaaaccagttgcgaaatggtctgaggcagagtgtggttcaaatacgccagacaccttttgaaagctaatttttggtgaagaaatggattcggttacataagagtgcaacttcagactgaagataggccaaggtcgtcactgatctcaagatttcaaccttgaccatgggcagtgaccagattgaaaggggagcaagttcggcagtgggagagttgaccgtgtcaccccctgcattgtgctgccatttggccagcctgtccaagggcatgacaccaagtagacactacagagagagaaacactacagcaacccagggttgtcctgaaacagacttttatacttgaacatggagactgcacatggactttagggtttgtgctgtgggataaacggaagctacagtgagaacatagccagtcccaaagacaatttcaaagaaaaatgacagtaaagattagctgggagtagtctttgacagtgcttatttgatactgtctctcagagtttgcaaaccagattgtacaagtcattagcgtcagatagctttaaagttgtgaccttcttgtacatgaatcttctagccagtttcctttcctttgtaacgaaacatgaaatcctagaatgtatgagaagttcagacattaggcataaggaaactcgtttgcaggctctctgtccagggctgcttcctgtcctggaggggccagtgagtcttaggtatgtttattttattctcacatttgtgtttttttagaaaagtgaatggtcaataaatggcttatctttcataataaaattatttgatactttta

SEQ ID NO: 579 - DNA, 1785 bp, Homo sapiens
cgagccggcaaaggcttgggtgtgagacagcagcggtggcagacaccgcagaagcaaagagcagtgaggctcctgcattcgggtggagcaccatggacgaagctggcagctctgcgagcggcgggggcttccgcccgggcgtggacagcctggacgaaccgcccaacagccgcatcttccttgtgatcagcaagtacacacctgagtcggtgctgagggagcgcttctcgccttttggcgacatccaggacatctgggtggtgcgggacaagcacaccaaggagtccaagggcattgctttcgtcaagttcgcccgcagctcacaggcctgcagggccatggaggagatgcatggccagtgcctcggccccaacgacaccaagcccatcaaggttttcattgctcagtcccgatcatctggaagtcaccgagatgttgaagatgaagaacttacaagaatctttgttatgataccaaagtcctacacagaagaagatctgcgggaaaaatttaaggtgtatggagatatcgagtattgcagcattattaagaataaagtgactggagaaagtaaaggtttgggctacgtacgatacttaaaaccatcacaagctgcccaagcaatagaaaactgtgatcgaagttttagagcaatcttggctgaacctaaaaataaagcatctgaatcctctgaacaagattattatagtaatatgaggcaagaagctttgggacatgaacctagagtaaatatgtttccatttgaacaacaatctgaattttcaagttttgacaagaatgatagccgaggccaggaagcaatctccaaacgcttgtcagttgtatcaagagttcctttcactgaagaacagcttttcagcatttttgatatagtaccaggattggaatattgtgaagttcaacgagatccttattcaaattatggtcatggagtggttcagtattttaatgtagcatcagctatttatgcaaaatacaaattacatggatttcagtaccctcctgggaaccgaataggtgtttccttcattgatgatggaagtaatgcaacagatctccttagaaaaatggcaacacagatggtagctgcacagcttgcatcaatggtgtggaataacccaagtcagcaacaatttatgcaatttggaggaagctctggatcacagttgcctcaaatccagacagatgttgtacttccatcatgcaaaaaaaaagctcctgctgaaactcctgtgaaagaaagactttttattgtgtttaatcctcatcctttacctttagacgtattagaagatatattctgtcgttttggtaacctgatcgaagtttaccttgtgtcaggaaaaaatgtggggtatgccaagtatgccgatagaataagtgctaatgatgccattgccactctacatggaaagattctgaatggggtgagacttaaagttatgctggcagattcgccaagagaagaatctaacaaacggcaaagaacttactgattcttgagaacaaagactaaataatgacataatcctcagctgactgactgaaaatgtgactggacgcattccctgtggacagttgacagctttttttttttccatatacctgatagtctgtgtacagcattgttttgtctgggaagcagggattgctgacatgtatttttgaatccatacattaatgctaaaacgaatatagtagttgttccttagagcaatatgttgttacgtgtagcagaaataaagttttctttgcttaactaaa

SEQ ID NO: 580 - DNA, 2903 bp, Homo sapiens
ggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaa

SEQ ID NO: 581 - DNA, 1769 bp, Homo sapiens
caagagcctcctgatctagcagccaagactccccctgacctttggccatgtaccccaaccctctcatctactgcacctgctgggacccctggaacttgggaccacggaagctaatcaagacccctcaactaccacgcaagaactccacagggagttccaagctaactcctcttgtaccagctccaaaaaatcacaattacctccaaccaacaaaacctgttgtttccccaaaaatgaaaatccattcagcaaggcaagaagagactaataaatcattttatgaagtgatcaacgtgtcacctggctatcaacttgttcggaatcgggaacagatttctgtcaccttaggggatgagatgtttgataggaaaaagcggtgggaatcggagatcccggacaaaggcagattttccaggaccaacatcatttctgacctagaagagcaaatctcagagctgacagcaataattgaacaaatgaacagagaccaccagtctgcccagaaattgctctccagtgaaatggatctccgctgtgctgagatgaaacagaactttgaaaacaagaacagggagctcaaagaggcccatgaagcagaactcagtgagttggagaacaactacaaagcagccttgaaggcagagaagttggctgcccaagagaagctagaggagatgggaaaagaatacaagtatttgaagaatatgtttcgtacgtatcaggacagtatttatgatgaaatggaagagaagtggtcaaaacagaaggcgaaatggaagaaggatgagaagttcgagcgagaaaatatcctgctacagcaaaaaaaaaagatgaccaaaaaattcgaaatggagtcaggagaagaagataagaaaataaatgaatcctgcagtgctgtctttgagaacttcattcaagagaaggaggagctcttgaaacaacatcaaagtgacaccttgcaattagaagagctgagaaaaaccaaagaggtgccctggagaagagaccaaataaatagacattggcatgatgtcctgcaacagcttcttcttatgcaggtcatgcaggaagaattgcatgcacaagcccttatcctagagtcactgaacacaaacctctactatacccagttggaactccagaaagagaaagctatagtgggaaatctggagaaaatgcttcaaaccaagtttgctgaaactgaagaaaagtataagcacaccatacagatcctgacggaagagaacattcatctgaagcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatggttggcacaccatttctgtaggcccaggaaactcctgggagggttttcttgagaaaatgcatataatgagtttagttcttgggttgctctgactctctgaatgtctgaaaatgtttgaattcgcatctgaatttcacagcttatcacggactcttcactgaaaaatgatgctctccatactgggagctgagctttctctgagttttgtactatttttcttctaccttgacgtatttcgttagaaagaaactgatttgaaggccttcttcatattgaacttttactatatttgggaggtgtacctttgtcccctggggcatttaggtagcaaaaaaagatgatgtgttgatttta

SEQ ID NO: 582 - DNA, 2104 bp, Homo sapiens
agcgggccgtcggttgggcgcagacaggccgcagaagatggagagatggagccaccccaagagacaaataggcctttcagcacacttgataaccgcagcgggcaggtccaagtcctgtccgccaccccgctattgcagaggaatccctacagcagcccggatatcatgcacattaaagggtcggaggcttcttcggtcccttacgccctgaaccagggcacgacggccctgcctaagaacaagaaccaggagggcaccgggcaccggctgctgaacatgctgagaaaaactcttaaagagtctgatagtgaagaactggaaataacacaggagacgccaaatttggtgccatttggggatgtggttggctgcctgggcattcatataaagaactgcagacattttatgcctaagatcagtttacaacattatgctaatttattcattcgcatctctataaacaaagctgtgaaatgtacaaaaatgtgtagcttgctatccaaaaacgatgagaagaacactgtaattaagttcgatgaagtgaagtatttttctgtacaggttcccagacgttatgatgataagcggaataatattttattggaactcatacaatatgacaatagagaaaaacgtgctttcttgttagggagtgttcagatacatctttatgaggtaattcagaaagggtgcttcattgaagaggtccaagtgttgcatggaaacatatttgtctgcaggctggaggtggaatttatgttctcctatggaaactttggttatggattttcacatcagttaaaacctcttcagaaaattactgagccatccatgtttatgaatcttgcaccacctccagaaagaacagatcccgtgacaaaagttattacaccacagacagtagaatatccagcattcttatccccagacctgaatgttactgttgggactccagctgtgcaatcctccaaccagccatctgtagtgcgacttgaaaaacttcagcaacaaccccgggaaaggctggaaaagatgaaaaaagaatatagaaatctgaatacatggatagataaagctaactatttagaaagcattctaatgccaaaattggaacataaggattctgaggaaactaatatagatgaggcatctgaaaacacgaaaagtaatcatcctgaagaggagcttgaaaatattgtaggagtagatatccctcttgtaaatgaggaagctgaaactactgcaaatgagttactggataatgattctgagaaaggcctgactataccaactttgaaccaatcggaccaagataattcaactgctgatgcttctaaaaatgatgaatcaacaccttcacccacagaagtgcactcattgtgcactatttctaaccaggaaacaataaaagcaggcagaataccacctttaggtgaacgtcaatcagaaagcatgccagacagaaaaatgaaaaatgtattttttccattagaagtaaaattaaaagataactatccaagcattttaaaagcagactcatctctatcagaggtggctttttcaccaaaagaatataattcaccatctttcagaccagaatatatagaattcaaaccaaaatttcaggattgttcagataaatttgaggatttacatgacatgacctcatttacacaccttaaaaaagtaaaatcaagatcaaggcttttaggaaaaagctcagatgatatccataaccatgccagacactctgcaagaccatatactgctccggaggttaacaagcaacgagaaagctacagtggaaagtttacaagtcgtcgaatggtttcatcaggcttagttcatataaatgataaaacatcagattatgaaatgcataaaatgcggccaaaaaaaattaaaagaggatattgaaaaatgttcgctcatttgtgatattataaaacatgtttaactcagaatgatatgtgaggccagcagtcagaatatcacttctccattaacaaaatggtttggagatctcttcttttgtgtgacagaagtcagcaaccaaatttcatcttgttagaaccattttgttttgattaaaatgaaaaacaaa

SEQ ID NO: 583 - DNA, 5976 bp, Homo sapiens
cacaggaaataagcaatggaggtggggtcctttgctcgcgccgaaattcaaaggaataaatagttccggcgcgggtgttgagagcggtgtggcaggtgttgtagccgctatggtgaagttcgctttgtagcggccccggctagagagttgttctgttccctgcctttgtgacccggaggagcttttggggtgcgtcaagcccctggcctgaggcagcggtgaggcgtaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagttacagaaagtccaatgtcaaatatagtttttttgtttcctttcaaatgtattacagactgtgccaaaacagttaccaattcacactgtcaatattaaagtataccatagtatacaaattagtcagtacttgctgttaattttaatatttctgatttaacagttagttattaagtggtacttcattgctgttttagccaacgttttaaaaataatttgggagtttgactattttggcttacgtactcatttccttttctctgctaaaaatgttttgcttgtgtgcgttcctgatttttgtcttgtataatcttgatctttgaaaaccctcaaacatgtattaaattgttgtaactttttttcattagagggaagacattaaggggattggggacatttgtttcacacatctgcagtaatatgagttaactaatatttaacaagctctttctttacattagctgctgttctcatttgtatgtattgtcatatttaatcctcagagtaacctagtgaggtaaatactgttgttgtcagcatggtgtaatcgaggaattgagtgagttgagcagaaaagttaggaaacttgctcagggtgataatacagttaggagtgtcagggcccatggacaaatcttgtcagtctccagaacctaagatatactacgtcactgacagcttgaacatttgtatttattgtacagaataaattt

SEQ ID NO: 584 - DNA, 1897 bp, Homo sapiens
tccagcgatcgcagcccagccccagctcctcctcctccacggcttacccgggctccgacagcggctgcaggtctccaagttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagattttgtcggtggttccagtttataacaacttcacaatttatactacggtaatgagcgccggtagcccagacaagtacatgactaggatcagaaacccgagtagaaagtaagtcagcagaagagcgagttcgcccgtgctgtgaaagatgattttttaaaaaatgaaattcttgaagagctgcaccttaaaaaataagacaaagtgaaagtattgtattatgttacaaacaatgcaggctccttcctcatttaactttacaaccttgcgaagtgggtccaggagatttggagtttgtggtaaagccagtaatgggcattgtcctgcattcccttcccttcatggtttgcctcgatcctctctaagcttctatcctggcctgaataactcaaagataattggtctcagagatcaagccatatcctcaggccttatttccatcttctcatgattctgccatcatacctttgcttctccgctaatgaaatgagctggcaagacctctgttcattgtgaagtgcttctgaaagagcctaagaaaaaaggctcatctgaaagaaatggagaactctatttcgaaccaagcctgtttgaatgtgtgttagtctgatctttgatcatgtgtttccatgtaatgggagtctcgttttttataatgtttctaacgttttattgaaaaacctatggccctccttctttctcaatagctactttcttactgctttttgaaaataatatgcaaccaaattatttcttaatgtcacataattaagtaataaaatgtcaaaagaaatgttggcaaggagaataaaaaaatttccaagaaa

SEQ ID NO: 585 - DNA, 2005 bp, Homo sapiens
gatcggggatcgtcagcttggttctggccacagaggttgctcttctcgcgatgcttcagacctggcggcagggaaagggtgggctaattggagagccaggaagagcgtgaggcggccccacgctgctttcccagaaggctgtgcgtgctcctcgcttcctccgcggtcttccgagcggtcgcgtgaactgcttcctgcaggctggccatggcgcttcacgttcccaaggctccgggctttgcccagatgctcaaggagggagcgaaacacttttcaggattagaagaggctgtgtatagaaacatacaagcttgcaaggagcttgcccaaaccactcgtacagcatatggaccaaatggaatgaacaaaatggttatcaaccacttggagaagttgtttgtgacaaacgatgcagcaactattttaagagaactagaagtacagcatcctgctgcaaaaatgattgtaatggcttctcatatgcaagagcaagaagttggagatggcacaaactttgttctggtatttgctggagctctcctggaattagctgaagaacttctgaggattggcctgtcagtttcagaggtcatagaaggttatgaaatagcctgcagaaaagctcatgagattcttcctaatttggtatgttgttctgcaaaaaaccttcgagatattgatgaagtctcatctctacttcgtacctccataatgagtaaacaatatggtaatgaagtatttctggccaagcttattgctcaggcatgcgtatctatttttcctgattccggccatttcaatgttgataacatcagagtttgtaaaattctgggctctggtatcagttcctcttcagtattgcatggcatggtttttaagaaggaaaccgaaggtgatgtaacatctgtcaaagatgcaaaaatagcagtgtactcttgtccttttgatggcatgataacagaaactaagggaacagtgttgataaagactgctgaagaattgatgaattttagtaagggagaagaaaacctcatggatgcacaagtcaaagctattgctgatactggtgcaaatgtcgtagtaacaggtggcaaagtggcagacatggctcttcattatgcaaataaatataatatcatgttagtgaggctaaactcaaaatgggatctccgaagactttgtaaaactgttggtgctacagctcttcctagattgacacctcctgtccttgaagaaatgggacactgtgacagtgtttacctctcagaagttggagatactcaggtggtggtttttaagcatgaaaaggaagatggcgccatttctaccatagtacttcgaggctctacagacaatctgatggatgacatagaaagggcagtagacgatggtgttaatactttcaaagttcttacaagggataaacgtcttgtacccggaggtggagcaacagaaattgaattagccaaacagatcacatcatatggagagacatgtcctggacttgaacagtatgctattaagaagtttgctgaggcatttgaagctattccccgcgcactggcagaaaactctggagttaaggccaatgaagtaatctctaaactttatgcagtacatcaagaaggaaataaaaacgttggattagatattgaggctgaagtccctgctgtaaaggacatgctggaagctggtattctagatacttacctgggaaaatattgggctatcaaactcgctactaatgctgcagtcactgtacttagagtggatcagatcatcatggcaaaaccagctggtgggcccaagcctccaagtgggaagaaagactgggatgatgaccaaaatgattgaaattggcttaatttttactgtaggtgaaggctgtatttgtagtagtactcaagaatcacctgatgttttcttattctccttaaattaagagttattttgtgtttgtattcttggctggatgttataataaacatattgttactgtcaaagc

SEQ ID NO: 586 - DNA, 2014 bp, Homo sapiens
atcttttccatctcctgctccttccgccttcccgccatccgccctccacacgattcagcccggtggtgttagccccctggactcgattcctgaggcaaacagtgccccttaaggtcggcgacagcctcttctgggttcactgcagtccaaccggttccctaccctctgccattatgaacatccgcaacgctcagccagacgacctgatgaatatgcaacactgcaacctcctttgccttcctgagaactaccagatgaaatactatttatatcatggcctttcctggccccagctttcttacatcgctgaggatgaggacgggaagattgtgggctatgttctggccaaaatggaggaggaaccagatgatgtcccgcatggccatatcacctcactggccgtgaagcgttcacaccggcgcctcggcctggcccagaagctgatggaccaggcctccagggccatgatagagaactttaacgccaaatacgtgtctctgcacgtcaggaagagtaaccggccagccttgcacctttattctaacaccctcaactttcagattagtgaggtggaacctaaatactatgcagatggggaagatgcttatgctatgaagcgggatctctcgcagatggcagatgagctgagacgacaaatggacctgaagaagggcgggtatgtggtcctgggctccagggagaaccaggagacccagggcagcacactttctgattctgaagaggcctgtcagcaaaagaacccggctaccgaagaaagtggcagtgacagcaaagaacctaaggagtctgtggagagcaccaacgtccaggacagctcagaaagctcggattccacctcctagagcatgcttaagcatttcaggtcctcatgtctcaaccacatctactctgtgaaccctggcttagtctgtctgctctgcagcatctgctgtggggatcatctcacagtgaccagaatggcttctcactcttaactctataaacaaccacctttcacatatcctgctgggatcatgaaggaatacctggacacaagagccactgcacaacagccaaggaactttgagacctgccattacagaacctttcttggcctactcacactacgctgccattttattctgtttgtagtagtcctctgttgggtgtggttatcctgcaagtttttctccttttagaatgatgaacaggaagcagggcaaactcttgaagatttccagctttcagtttttgtttttgttttttaaccattatttacctgagttttcatccttgaggaggtgaagtagtcaggaccatgaagtcagacctcatgccctcttcctcctctttcctggaagaagtattcagtttccttttcctttctctggtaactcctcctttatactattcccccctcccttttttttgaggaggagggcatcaccttcccagtgggaaaaggtgttaagttaggagcttctactgtacaatcagaacttggagattttaagaaaaggacaaacggtaattaaattggaatctctaatgtgcttgtttgtgttagtttttttgtgattatgtcacttggcatttattgagtacctgcagtgttcacacacaatgctggagccttcattagttacatatttaaccctctcagcaaccctgtaaagtaggtagtattatccctgttttacagatgaggaaactgaagctcagagaagtgaattaaatatcctggatctgaacccaattctgtttgaattcaaagccaaagttccttctacttttctgttcctactctttgcattttatttataaatgtgttaaaattttagcaaaaatggagaatctgctgtttaaaaatgtgtttgcttaatacatggctactgtatgtcaattgtaaatatttatataacctacaattataatctatttttattatttttctctagtaaaaataagtgaagacaaagtaccttgacctctgcagtaaaagttaccagataaa

SEQ ID NO: 587 - DNA, 4453 bp, Homo sapiens
aactccattggataaatggcgaggaaacgtatactccctcttaaggaacacggtgtcttccttcgtctccgggttcccgagaccccagagtcactgacctccgtccctcagctttcggggttcggcagcagaaggggcgggcccgggcctgggattggctggcgtcgtccgacccccttcgctgctctccattcgcaatcgcccgcgggcgcctgcgcgatgggtcggccgtggggagcggggcgggaagcgcttcagggcagcggatcccatgtcggccctgaggcgctcgggctacggccccagtgacggtccgtcctacggccgctactacgggcctgggggtggagatgtgccggtacacccacctccacccttatatcctcttcgccctgaacctccccagcctcccatttcctggcgggtgcgcgggggcggcccggcggagaccacctggctgggagaaggcggaggaggcgatggctactatccctcgggaggcgcctggccagagcctggtcgagccggaggaagccaccaggagcagccaccatatcctagctacaattctaactattggaattctactgcgagatctagggctccttacccaagtacatatcctgtaagaccagaattgcaaggccagagtttgaattcttatacaaatggagcgtatggtccaacataccccccaggccctggggcaaatactgcctcatactcaggggcttattatgcacctggttatactcagaccagttactccacagaagttccaagtacttaccgttcatctggcaacagcccaactccagtctctcgttggatctatccccagcaggactgtcagactgaagcaccccctcttagggggcaggttccaggatatccgccttcacagaaccctggaatgaccctgccccattatccttatggagatggtaatcgtagtgttccacaatcaggaccgactgtacgaccacaagaagatgcgtgggcttctcctggtgcttatggaatgggtggccgttatccctggccttcatcagcgccctcagcaccacccggcaatctctacatgactgaaagtacttcaccatggcctagcagtggctctccccagtcacccccttcacccccagtccagcagcccaaggattcttcatacccctatagccaatcagatcaaagcatgaaccggcacaactttccttgcagtgtccatcagtacgaatcctcggggacagtgaacaatgatgattcagatcttttggattcccaagtccagtatagtgctgagcctcagctgtatggtaatgccaccagtgaccatcccaacaatcaagatcaaagtagcagtcttcctgaagaatgtgtaccttcagatgaaagtactcctccgagtattaaaaaaatcatacatgtgctggagaaggtccagtatcttgaacaagaagtagaagaatttgtaggaaaaaagacagacaaagcatactggcttctggaagaaatgctaaccaaggaacttttggaactggattcagttgaaactgggggccaggactctgtacggcaggccagaaaagaggctgtttgtaagattcaggccatactggaaaaattagaaaaaaaaggattatgaaaggatttagaacaaagtggaagcctgttactaacttgaccaaagaacacttgatttggttaattaccctctttttgaaatgcctgttgatgacaagaagcaatacattccagctttcctttgattttatacttgaaaaactggcaaaggaatggaagaatattttagtcatgagttgttttcagttttcagacgaatgaatgtaataggaaactatggagttaccaatattgccaagtagactcactccttaaaaaatttatggatatctacaagctgcttcttaccagcaggagggaaacacacttcacacaacaggcttatcagaaacctaccagatgaaactggatataatctgagacaaacaggatgtgtttttttaaacatctggatatcttgtcacatttttgtacattgtgactgctttcaacatatacttcatgtgtaattatagcttagactttagccttcttggacttctgttttgttttgttatttgcagtttacaaatatagtattattctctacttcttggtacattttgtagtaatatgtttaatataattattcaagagactatattgacagccagatagtatggcagttctgaaaaaatttatatcttttcaccacttgaatatactgcaatgtgtagtgagtaaattgtctccctttttctatagatcattaggttagagtttttttcttcttttttttttttttttttttttaccacttctgctgttcatggtagtagtggaaggtaaatttggaaatggcattgacataaaatgaaaatgtttacggacacttttcttttttgcttttttattgtatttggataaagatccacttaaaagttatctgttttttcctgttttttttttttttccccaaagtgtagttatgttttcactattgctgcttctatagagggcattgtgatagagagttacagatgaaacattaaatgccacagtgagtagaaataattactacaaaaagtaataaatatgattacttggtaatatcattctccatctaaaatactagtttcacctgtgagcagatttcagctcagtttatagttaaaaacaatgagggtaaaatgggattcatgctcagggaatgaatcagccatagttagagtgggaaattattattttcttcatttaaaggtagattttatgtttatttccctaaattgcataagataaaattgtctgtttaataaaaagacatttattaccattattaacagtcattttagagccaaatttaagaaaaggatattgaaagggtctttattggccttgtttgggtaactctatgctgttagatagaagagacttaggtaaataactttttatgtctgaggtgagtacacaatattggttcttggaaaaatagctgtttcttcataagatacccaagtgataattttttttcccctagactgtcaggcctatgagtaaatactaaatctattagctgtccccactcataaaccaaaccaaaccaatacaaacagatgaggagaggaaatgtagtaaaaatactggctgggtcttatgattgggatgagtgattttataagataatatggtgataattttattctaggattttatttttggcctaatataggaatgtttaaaaaaggcttttctatgaaaattagaaatttatacttgaaattaaaagtctagaagggggaggaccttaaagctaagctaccagtaagacaatgaataattcagaagagaacactattcttttactgactgagtgcccaagatgccaatttccatgaagtcttgatttatatatatgtacacatgttatgcacatacatgtttgttttctaacagttattttttaagcttttgagataattttagacttacagaagagttgtaaaagtagtagagttcttgtatactctgcacccaccttgcccttatgttaacatcttacgtaacaatagaacatttgtcaaaattaagaaattaaccttgatataatactaactaaagtagaaagtttaaaaagtagagattttagtcttttcactaatgtccttttactgttccaagacccagccttgcatttagctatcatgcctacgtcctgtcttccagtctgtgacagtgtatcataacaggggatacctgatgttgtaatgtatttctggtgttgttaaccttgatcactatgctaaggtggtgtctgctaggattcgctactgtaaacttactgtgttttccttgtaattattgaatatttgctggagatacccggagactatgcaaatgtcccgtttctgcttaaacttttgctcattttactatccattggcagatcttgcttgtggcagttactactgtggtgttctaatggtgattttctatttctctcaatccttctacatttattattggaattcttctgtaaggaagagttgtcagttctggatttatatttttaactataataagatattcaggataagtatagatttagaacttaaagatgttaaatcatgttaaaattattccaaataccaatatcaaagaaaactaagttggtaatctatctcagaaaatatatgaacttaagaaggaaaatagtatttatgatttgtagaattggttcaacttttgacttaatactgactttggactgaattcaaagttttcttgaaatttcacatctggactttttaaagtgtctacatttatattactttggggatcattttgtcaaagtcttgaataaagttacccagtcctggcatgataaacacaa

SEQ ID NO: 588 - DNA, 3502 bp, Homo sapiens
aaatttcccgggccgggagcgctgggcctgccgggaaggcgctgggacggttacccagcgggccgccggcggtcgtgggcaagcttcgccatgcagagcactgacctaggcaacaaggagagcggcaagatatggcaccgcaagccgtccccggccacgcgggacggaattatagtgaacattattcacaacacttccgattaccatccaaaagttttgcgatttttgaatgtggcttttgatggcacaggcgactgcttaattgctggggaccaccaaggaaatatttatgtttttgacttacatggaaacaggttcaatcttgttcagcgaacagcacaagcttgcacagctctggcctttaatcttcgtaggaaatctgaattccttgtggcattagctgattattctattaaatgttttgatacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggttttctttctaccattaagtaataccatcctcagctgttttaaagataattccatttttgcctgggaatgtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataagccacctccgcctttagtgaaagttattgaagatttgcccaagaataaactgagttccagtgatcttaagatgaaagtaacatcagggagagtacagcagccagcaaaatctagggaaagcaaaatgcaaactagaatattaaaacaagacctgactggtgattttgaaagtaaaaagaatgaattaccagatggattaaacaaaaagcgtttacaaatcttattaaaaggctatggtgaatatccaacaaaatacagaatgttcatttggcgctctctgctacaactgcctgaaaatcatactgcgtttagtaccctcatagataaggggactcatgtggcatttctcaaccttcagaagaaataccccatcaaaagtaggaagctactcagagtattacagagaaccttatctgcattagctcactggtctgtcatttttagtgacacaccatatcttccactcttggcatttccatttgtaaaattattccagaacaaccaactcatctgttttgaagttattgctactctcataatcaattggtgtcaacactggtttgaatattttcctaatcctcctatcaatattcttagcatgatagaaaatgttttggcatttcatgacaaggaactgctgcaacacttcatagatcatgatataacctcccagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgagtttttttttcaccatcggaataacctggatataaatgttgtgattagacaagtttatcatctcatggagaccacgcctactgacattcatccagacagcatgcttaatgtttttgttgcactgacaaaagggcagtatccagtatttaatcaatatccaaagtttattgtggactatcaaacacaggaacgagaaagaataaggaatgatgaattggattacttaagagagaggcagacagttgaagatatgcaagctaaagtcgaccagcaaagagttgaagatgaagcttggtaccagaaacaggagctgcttcgtaaagctgaagaaacaagaagagaaatgctcttacaagaggaggagaaaatgatacaacaaagacagaggctagctgctgtgaaaagagagctgaaagtaaaggaaatgcacttacaagatgctgcaagaaggcgttttctgaagcttcagcaagatcaacaggaaatggaactaagaagactggatgatgaaattgggagaaaggtatatatgagagatcgagaaattgctgccacagccagagacctagaaatgagacagctggaactcgaatcacaaaagagactttatgagaagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaaggtgattaaagaaaatttggcaaaggctgaacaagcatgcctaaataccgactggcagattcagtctttacataaacaaaaatgtgatgatctacaacgaaacaaatgttaccaggaagtagccaaactccttagggaaaacagaaggaaagaaatagagataataaatgcaatggtggaggaggaagccaagaagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcgagagagagacctattttgcaatcagtgacattgatttttagattatttatttaaaattcctataaagatcagccctttgtacagaaaaatgtgtctataaaaattatgtgttatttaattctgatactttttggcttgtaaatggcttcttgaactttttacaataaaaatgttttagaaactgtt

SEQ ID NO: 589 - DNA, 1349 bp, Homo sapiens
cctctccccccgggctccgcccaccccacgccgggaacccacgcgggccactacaagcccgccctttcctacgtctggtccagtcggtcttcctccggcccgggccctggcccagctagccggccatggaaggtaatggccccgctgctgtccactaccagccggccagccccccgcgggacgcctgcgtctacagcagctgctactgtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtctttctcttttaatttgattgagtggaaatctgagtgaatacaaatataaatgaacaacataaaaacttttgttttgacatgtcaaattgaaacttgataaagtgcgtacttgctaagatattcctgtggctcatgcgttacaacacgaggacttaagccagtaatcgtttttgttcagatagaggtgtggaggtagagccagcccctcatgtctgttttggatgttttgtgtctctccagctacattgtaagttccttgagggcagggccatggcccattgctctgtgaatctcaaatgcccataaaaggtgcccataaaatgttttcttgaacatttgaatgtgctgttgtctggaaaggggtaatattgtgagctgaatcagcaataagtattagtctttttggactatggtattgttaaaaagactgcagccctctcagacttgagcgttaattggcttatttatttatggctttaaataaaatcgatttaacgtta

SEQ ID NO: 590 - DNA, 3880 bp, Homo sapiens
cccctcgtttctccctccccgcctcctccgcagaagccgagcgccaaactcaaactttatcaggacccggacctctcaggctaatcccgagggccgggcctgttgggcttttctgcacaccagccgaggcagcgagccaacatgagccaagtgctgttccaccaactagtcccgttgcaggtgaaatgcaaagactgtgaggagaggagagtaagtataagaatgagcattgaactacaatcagtttctaatccagttcacagaaaggacttagttattcgtctgactgatgacacggatccattttttttatataaccttgttatatctgaggaagattttcaaagtttaaaattccagcaaggtcttctggtagacttcttagctttcccacaaaaatttatagatctccttcagcaatgtactcaagaacatgccaaagaaattccaaggtttttgctacagttagtttctccagcagctattttggataactcacctgcatttttaaatgtggtagagacaaatccttttaagcatcttacacacctctcactaaaacttttacctggaaatgatgtggagataaagaaatttctcgcaggctgtttgaaatgtagcaaggaagaaaaattatcattgatgcaatcactagatgatgctactaagcaactggactttacacgaaagacattagcagaaaaaaaacaagaattagataagttacggaatgaatgggcgtcacatacagcagccttgacaaacaagcattctcaggaactgacaaatgaaaaggaaaaagccttgcaggcacaggttcaatatcaacagcagcatgaacaacagaaaaaagatttagaaatcctccatcaacaaaacatccaccagctacaaaacagactgtctgagttagaagcggctaataaagacttaaccgaaagaaaatataaaggagactccactattagagaacttaaagcaaaactttctggtgttgaagaggagctacagcggactaagcaagaagtcctctctttgcgaagagagaattctacactagatgttgaatgccacgagaaagaaaagcacgttaatcagctacaaacaaaagtggcagttttagaacaggaaatcaaggataaggaccagcttgttttaagaacaaaagaggcatttgatacaatccaggaacaaaaggtggttttagaagaaaatggtgagaaaaatcaagtacaactaggaaagcttgaagctacaataaaatcattatctgcagaacttctgaaggcaaatgaaattatcaagaagttacaaggggatctgaaaactttaatgggtaagttgaaattgaagaatacagttactattcagcaagaaaaactcttggctgagaaggaggaaaaattacaaaaggaacaaaaggaattacaagatgttggacagtctcttcgaattaaagagcaagaggtatgcaaattacaagaacaattagaagctacagttaaaaaacttgaagaaagcaaacaacttctaaaaaataatgaaaagttaatcacgtggttaaataaagaactaaatgaaaatcagctagtgagaaagcaagatgtattgggaccttctactactccgcctgcacattccagcagcaacacaatcagaagtggaatttctcctaacctgaatgtggttgatggtagactgacttacccaacctgtgggattggttatcctgtctcctctgcatttgcattccagaataccttccctcattcgatatctgccaaaaataccagccaccctggttcaggaacaaaggttcagtttaatttgcagtttacaaaaccaaatgcatcactaggagatgttcagtcaggagcaactattagtatgccttgctcaactgataaggaaaatggtgaaaatgtagggttggaatccaaatacctgaagaaaagggaagatagcattcctttacgcggactcagccagaacctatttagtaattcagaccatcagagagatggcactttaggagcattacatacatcttccaaacccacagcgctcccctctgcgtcttcagcctatttccctgggcagttaccaaacagttaattctagtgtcatgttttactttttattggtattttagaaactcaggtgcttaaaaaatatgtcaacacaaaccagatcctcaaatagcaagtttcaaattttacttgagctgttaaagactggatactttaagtactgcttttatggcagtttataatataggaacaaatttgtacttggggattggtaaagattgtgagtaaatgacattttttggtttgtgaacatggcgttttatagaataatatgaattttattaagctattctttagaaattcagttctaaggaaagagttgatccttatgagggagattctgatcatattaaaaatctgggtaaactaaaacctgctcataacctcatagtatgcaaccaaagaatactaattcattttatcactttcattggtaaaacttttaaattcaacacctgaaaatcatgagggaaaatgattacctcttgagatatattattgatgacatttaaagggaaaagtcctaaatttaccttaaataactgaaatgaattaagccttcatagcgtattttccttgaagcatttaaatttgctagtgatgaatcaaataaatttgatatacttaaaataatttggacagtttttatgtgaccagattaagtgcttttgtcatttgagctgacaagtttttaaaacttcagtgcttcctaaatgtttatactcatctagtttttctcaatttgtagttttattatgcagttaaatctgtatcagtggacttttaaaacttggtactactactaaatctactatatcatgaatattcatttatttttatagtatcagaacttgggttgatttcaatgttaataaactaggcaaaacaaataactgttagaaggtacaattttcttctcttccctgtaactgaaagttttaagaattgttccttggggaaaaatttttttaaaattcacctagaatcatagggcctcattttgttttcttattgacaaacaatacctggtagcattctctaaagagtcttctagatcaatttttataaagtactaatgctcatgtgataatttaaaattattttcaactactttattacacagatgaagaaacatttcaagatattgatgtaataacattactgagtcccatggtaagaaagaatctttgctaattttttttttttttttacgaagccagtatcttgaaactattggcaattgcaagtgtctttaaactagggatctaatctgaaaattcagtaactaatattaggcagttgatactcccccacctcccccatttagatacactactgtattagtgagaatacttggtacagtaacttgaaagcacttgctattctggaaagaagcctcttggtgattttggaaggagctttattgtaaatactatggaaggggctttgttgtaaatactatgtaatatatataaaatattgtgacatgttttggatgggatgcatgacatacaggtagctctcttttttaaaatataggtatctctttgcatatatatacacaaggaaagttgaattttcaggagagatcattctgatatcttgcaaatttgtattaaatgtatacagacttccaagtgtgctaattctttacctcctaaacttttagttgcaattgttttgcagtgtaaaattgtacatgtgttaataatcaaaaagtgttgcatttaatgttatttctgtaaactttgagctttgttaataaactattatgcagcatctacactttg

SEQ ID NO: 591 - DNA, 1412 bp, Homo sapiens
gccgggggtgggaagaagactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaggatactgtaacctttttgtctttttttttttttttttttttaaacctccacctccagtggctgtgactggtcccagtgattatacgttattggttgctgtgggtctgggcgggcctggagccagaaggcgacttattttttctctcctatgccaccccaggtggggagggagggaggtttcagactccagtttctcccttgcccttttattcccaagcctccttggccccagtataagtgttgggaactctctgccagcttcctgagttctgcctaaagatggccccccagcactggttggggacaagggccaaattggtgaccaccagtcatgcctaggacctggggcccaaaagccgggcaacctctggctacaggggccattgggtgccctcccagttgagaggggccgctgtttcgccttgtccgtcagtgccagtgcctgtgccagaggtggcgaggtgagtcctccagagcttcctggccgggccctcctcctgcctgttctggctcctctgctcccacgctagctgtcccttttctgattctggtggatcctccctcccctaattaaagtctctttttgcccctttggggctgcatgaggtc

SEQ ID NO: 592 - DNA, 1204 bp, Homo sapiens
gcgcggcccgaggggcgggggcggcgggcggcccggggctgcaaagcggggggccgccgcctccctgggcctgcctgggcggccgcctccgcgatgccgctgctcgtcgaggggcggcgagtgcggctgccgcagtcagccggggacctcgtccgagcccacccgcctttggaggaaagagccagacttctcagaggtcagtctgttcaacaagtgggaccccagggccttctgtatgttcagcaaagagagcttgcagtgacctccccaaaggatggctccatctccattctgggttctgatgatgccactacttgtcacattgtggtcctgaggcacacaggtaatggggccacctgcttgacacattgtgacggaaccgacaccaaagctgaggtccccttgatcatgaactccataaaatccttttctgaccacgctcaatgtggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgttttctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataaaaccttattttggcaaaggca

SEQ ID NO: 593 - DNA, 5663 bp, Homo sapiens
ataaactctaaggaagacagtgatggagtgaagtgggctgggggcgatagagaggatggggtggggcaccaggcgagagatgcgaaggaagccagaacgaaaagagagcgaccgaggagagaagagagcagagcaatacaaaagcagcctcggatctagccggagctgcaagcgttaaggggaggcggagagtgacgcggtttgcgtctggagcggctccttggagtccacagcatccaccgccggagcctcgccttcctttctccctctgcagacacaacgagacacaaaaagagaggcaacccctagaccaccgcgaaggacccatctgcaccatgaccgagaccaccaagacccacgttatcttgctcgcctgcggcagcttcaatcccatcaccaaagggcacattcagatgtttgaaagagccagggattatctgcacaaaactggaaggtttattgtgattggcgggattgtctcccctgtccacgactcctatggaaaacagggcctcgtgtcaagccggcaccgtctcatcatgtgtcagctggccgtccagaattctgattggatcagggtggacccttgggagtgctaccaggacacctggcagacgacctgcagcgtgttggaacaccaccgggacctcatgaagagggtgactggctgcatcctctccaatgtcaacacaccttccatgacacctgtgatcggacagccacaaaacgagaccccccagcccatttaccagaacagcaacgtggccaccaagcccactgcagccaagatcttggggaaggtgggagaaagcctcagccggatctgctgtgtccgcccgccggtggagcgtttcacctttgtagatgagaatgccaatctgggcacggtgatgcggtatgaagagattgagctacggatcctgctgctgtgtggtagtgacctgctggagtccttctgcatcccagggctctggaacgaggcagatatggaggtgattgttggtgactttgggattgtggtggtgccccgggatgcagccgacacagaccgaatcatgaatcactcctcaatactccgcaaatacaaaaacaacatcatggtggtgaaggatgacatcaaccatcccatgtctgttgtcagctcaaccaagagcaggctggccctgcagcatggggacggccatgttgtggattacctgtcccagccggtcatcgactacatcctcaaaagccagctgtacatcaatgcctccggctagcagcccctcgtcctccggcaacacaatggcccctccatctttgtcagccccctgtttctctcctgcctctctgtttctccatctcctcgtcttgactgttttccctacttgctgacttaaccccccatagtgtgggggacctgcagagaaccatggcattccctattccacagtcatctttggacagactttcctctagtctccgggttgggggtgggtgagggaatggggtgggagtcgggggaagtgcagtccttggagatgtactggtgtccgtctcccagcatgctctagagaggcggctctggtgcccatcctcccagcacgctctggggaggcggctctggtgcccatcctcccagcatgctctagagaggcggctctggtgcccctcctcccagcatgctctggggaggcggctctggctcttgccttcccagcatgccctttactacaaagggctatttttcttttctttcttttgtttatttatttttctttgttcactccctgtagaacttggatgaaatcagtgtccatggttctttatgtttgtagtcttgatgtgctcctgtggtattacttcccctctgataggacattgtagccagcctcagcactcagtgagttcatcagggccacacccagtagagaaggccaagcaacctccacttcttcagcaccacacacacgcacacacacacacacgcacacatgcgtgtgcacccgcgcacgcacatacacacacacatatagcagtagcagcagcagcagcagcagcagcaacctttgatcaggagtgagattttcgggttctgaaacctgggacacgagtctgtgaatagtcggttttctcagaataatttgaatctgttttcttagtttcaaatgaccatttccctgatgctctgagcttatgatcacacagagccagtccatcctcatttcctggtggcatctgttcatttacctttgtggactgtagctgatggcacagtgcgggttccctaccagccaggggtttccaagggacctttggaggccatgcttagacacattcctgtacctgagaacaaccacataggcaggaccagatccacatcgtgcagtcgtgtcataaaaaaacaaaacaaaacaaaaaaacactaggagtccactcaaccctggaggtctttgctaattggaattatgtattgtctgttgggctgggaaatgtctctttcatattgtaagtccaggatgaactaggagaaagcaatttgttgccctgatgataactgatgattttcaccctctctagctgaggtaactcagacagtgcatgaggtcagtttcttcttgagaagcagtgccttggtcttgtttctgtggttggttctagcccctgcagagcctgggagctgcaggaactgtctgagaaaatctccctaataggggagtgggttcccagaagggagatctgggaggggtcaggagccactaagttgcttcactccttttttctctaattttctaccttcctctctgttcctgcagacagttttgccagctttgcttctggttactagggtctcatgcgtgtcctgcttggagagccataaggaaattgctgtcttgtgctttgtgtctctcatccagtctctggctcttgggattctggtctttgagaaatagtccctgagtattaggatacttttatcaaaatctagtaccagctacggccagaaagggccaggtgggacctgaaagcaaagacaatgttctttaccacacgtttcacatctgcaacatccttcaattgcgggaaaaggaacttgatttaacagaagaacatggtagagcagcatccagaaagtctgttattcctcttggattttttgaaataatcttcagaggaaggaaggaaaatcctattttggggtatcagtgtttgactagggatcatgaaataataaactgaaaaaaactttagagttcagttgatccaacactttcctttaaaagttgagggagcagaggcccatgggattaaatggctggtccaggtcagccagcaggtgtagggcctgacaagaacatattgtttccctgacccctaggccgtcacaccacaccctccatttcctcatgttgctgaccaggtgcccatatgatttctacacttcccaagccttaccctggcatctttcttttaaattatatctgtcccaggtgctctccacacataggatggtaatgccagtcccaggggagggtgtgatagtaaggaaggccactgttaggtttcctttagaaataaagagatctcagcagcttggaagaaatcccagaagcggactccatcaatccaagaaagagttgctttgtggaaggtgaaggaagacccacagagtgctcaggatgatgctattgctggagagcgaaagatggaacagccttgtccaggcagaacagtcataagccaggaaatgaaacaaaggaaaacaggtgcctgaatttcctggggaaacatggcttgtttaaggacttggagttatggatggaatttatgggacccacgtgagcagacctgaggaaggctcgatttcttttgtttcttggtccactctgtcactctgctctggtcaagccccatttggtctacagcccatgagaaggaatgaggctggttctgcactctcagcatgcagtccgaaagcatgtgggagtggggagggaaagtgagatgaattaagacaaagaacaggtgccatagaagtagatttctaggaatgaagtggggcagatcttatctttgtggattacaggcactgtactaaaaacaggtttcctatttaatataaaaagaaagtgaatcttcttttggatagaatcatccattcccatcgccgcaccccctaccccccaaacacacacacacacacacacacacacacacacacacacacacacacacacgccctactcttcatttgctaggggaaggtcacagcacaactaaatccaggacaggacattgtgaccatgacccagccacagtcaataccagaaagatgattcagagtctgaagtggtgccccaggtgccaacaggataacctctaccccccgactttgtctctggggtcctgttccttcctgcaaagcccaatccaagactggcatggctcagaggttgtgagaaaggcatggactggaacaatcatgtccagaggggtctggagctttgtttcctgttcaccagcaaaaaatgtctctcccatttttctgaaagtggctgatgtaagaacaggcagaaggaaaaccctttttgtcaataactctgtccttaaggaatggtcctctgggagggctgtgctgctagtgggtacctcagtcacacacccccaaccccaggcagcctctagagccttcttgctttcattttccttgaatgtacataggaacaagggggaaagtctcttactgaagtgcctgaaacccaaagctagagcttctagagacgccgttcttcctgtctcagcttggccagcctttcaacaatgttctctagtttcaagctccagcttctcagaaagaattaaagaacttgctgttcaaattaagtagaaagtgagactcaataataactgaactacagcaaaaggcagagaattacagggagaaaaaacttgtacttaccagcccaattctactctcctcaaactgacacacacacacacacacacacacacacacacacacacacactcttttaggggactaagagagagaagcatgttattacattttactcatccaaacagtaatgcaaaaataaaacggtagaatatgaaaagctcaggatctctcccaaggctacctactgcaggagggccaacaggtgagatgggaagaatggaaacagggaccgattttgtagctcatacaattaggacaccttaggaatagcattgtagtaatggtgatgaatatgctctgccaaattcatccagtctgcaccatcttatagctgcccagcacactcgactgttcatgtggtctctttgtagtgtgagtttggagtgtcctattagcctgttctggttaggaatgagttaacggctctttccctcaaccttagtctagtcccagggctgaggattcagctggatccacatggtcttgagggttggcatgaggagggggaagcttttttgaatcgctttttgatcacataatctgccattttaagagtaagatttgctttatggaaatcaattcattaataaaaaatgatattcaagttgcaataccatttcacagtgaaatattttgagtacaattttgttgctagaatagtcatgggcaagagttttatgcaaaatgtttcaattatgttaataaataagacaatgctacaaga

SEQ ID NO: 594 - DNA, 4401 bp, Homo sapiens
tctaccagtacctaagatggccgccggcccatccaccgtcgcgatcggtgtgaggaaagtgtcacgaacccggaattgcccgactccgtcatggcaggcgccgggggcgtggcttccggcggccacagcttgctagtcgccgcggcggggtcgagcgggggcggcagctgacaggcgctcctcccccgaccgcagcggctggttcccagcgaggcgggcggcccccagctcgcgtccccgagtcctagcccgcgaggcgccagggctgcgcctgggcatggaagaggggaagatggacgagaatgaatgggggtaccacggagagggcaataagagcctggtggtggcccacgcgcagcgctgcgtcgtgctgcggtttctgaagtttcctccaaataggaagaagacctcggaagagatatttcaacacctgcagaacatagtggactttgggaaaaatgtcatgaaggagtttttgggggagaactatgttcattatggggaggtcgttcagctacctttagagtttgtgaaacagctttgtttaaagatacaatctgaaagaccagagtctcgctgtgacaaggacctggatactctcagtggttacgctatgtgccttcctaatttaaccagactccaaacctaccgctttgcagagcaccggccgattctgtgtgtagagattaagccaaaatgtgggtttattcctttctcgagtgatgtcacgcatgagatgaagcataaggtctgtcgatactgcatgcaccagcacctcaaggtagcaactgggaagtggaagcagatcagcaaatactgtccccttgatctctactcaggaaacaaacagagaatgcactttgccttgaagagtttgctgcaggaggcacagaacaacttgaagatatttaagaatggtgagctgatttacggctgcaaagatgcccggagccccgtggctgactggagcgagcttgcacaccacctgaagccgttcttcttcccttccaacggcctggccagtgggccccactgcacaagggctgtgatcagggagctggtgcacgtgatcacacgggtgctgctgagtggctcggacaagggccgggcaggcaccctgagtccggggctcgggcctcagggcccgcgagtctgcgaagccagccctttcagtaggagccttcgctgccaaggaaaaaacaccccagagcgctcggggttaccgaagggctgtcttctgtacaaaaccctccaggtgcagatgttggacctgctggacatcgaaggcctctaccctctgtacaaccgggttgagcgatacctggaagagtttcccgaggagagaaaaaccttacaaatagatgggccttatgatgaagcattttaccagaagctgcttgacctttccactgaggatgacgggacagtggccttcgcgctaacgaaggtgcagcagtaccgcgtcgccatgactgccaaggactgctccatcatgattgcactgtctccctgtctgcaggatgccagctctgatcaaaggcctgtcgtcccttcatcgaggtccaggtttgccttttccgtgtctgtgctggaccttgacctcaagccctacgagagcattccccatcagtataaactggacggcaagatcgtcaactattattcaaagactgtacgtgccaaagacaacgccgtgatgtcgactcggttcaaggaaagcgaagattgcacattagttctccacaaggtctaactctttccctgcagtgtctttgaaacttgaacataatgtgaaggctgaatgatagagatattttctgttgtgttgggtgacctttggttgtgaatgtttttgcttttaaccccttttgaggtgggattgcctcttggagacatggaattgaagagcactagaaacaacttcctggacaaggaatgtaggaagtgagtgctgtgtcccaggaagctgctcacactcttaaaatggaagtgtccgttaagccctgggaagacgttctggatagttcttctttcccaaccagggctcatgtctgattctctaatgcgaaaagccttattctaagacccaaggtttggatctgctaccaccagactcctaacatagaaaacttgaattgtcacatacattttacagtttggacttttaagaaaacatggatactactggaacttcccccagctgagttacatggtcactttttcagtgcaagccacatatcaacacaggtttttaggtggttccctgctgcacagcgtgacctcgtggtcgcgcagatgccgattctgagcagtgtagactcagggtccctgtggaggtgctgaagcccacagttccacacagggcagcagggagcgcaaggctcaggtcaggatggacaccactcatgcgagcattgacctttttttttttgctttacaatttaatctttcacatgagggggagatgagctgttctttcccactaaaaattgctgctgtagaagttggaggtggagctgtgactggctgagctgctgtggccgggctgggcagtgtgccccaacagctcagtgctttcctgacactccagtgtctggggtggttgaggagcgagttctctcttcctcccagaccaagttcctccctcgggtttgccttgagacgtgttgcgtttttgggccccgtggcctctccctgttaggctgccacaggccctgcttctggaaggtgaacagctcctggctgctgccgagagggttctcgttggggtcaccaaagtgtgcccggctgctatgaaaaacgttgggaatcttggtttcagttttttattctatgctaggttgtacagacttatttatatcatcgttttgagggactaatggaggcttattgtaacatataatattagtgaaaccatggaattatatgaaaatgatacatgagaaataaggaaactattttgctgattgtaaatttttgtgggaaattttgtgataacttgagaattatacttgtttgaatcaaggcaactcttctagaatttattgttcaattctgtcatatttacttctaattctactctcagaggtgcaaaaagatacttatctaactggacacttttactgttttcttctcacttccaatgacaccgtctcatacacacgggtcctgtgtgctgggatgggggctttggtgaagtgcacggagctcacggacaagccgcaggctctgggaagcgtggaggtagtggccgttgagtactgtcttgacccaagggagttcactgttgctgggctggggctggggcagcctggtttgggatgattttgcccattgtcacggtgtgtggaggatgctgggtcctgggttcaagtgcacatgtgagggaaccccagtccgtgggaaggtgggctgggctccctaggtccttcagggctgcaagagttattgcctagcacagggcccagacagggctggactagacacgatgaaaacagcctgtatttgagggagaagagaaaacagatggagacccccactctgtctggtcttggctcccaccagcccgggctgtgaggagcccctgagccgcgggtgccactgctgtggatgcgtttctggcccgtcttggaaactgctgctgctgcgtagtcatgacggccctgactggtttgagacaacacgcgttcacagatcttaacaatgctaaatgggcgactgatgaggtcacggttcttaaggcacatccgggacgatcgatatagcacttaggctatgcaggggggtctttctttcataaaggacctcattccttgcgtcccagcccaggaacagtgctgtctttgctgtcttaggccattcttgttattaagctgacagcttcactttcttgtggaagaccaagaacagcatgaggacttgctgagactgcctcacggtgccaccatgcggaccggggggaggcagggagtgagggtgtggctcccctgggctactaaggacagtttaaagatgaggcgccataggcatccgtctccagagcccccaggaggcaggaaccaggataagggtggcttctcccagctgagtaatgtggccaccatgtccaaggtggactcggtgtgaggctgcagtgggtgggggatggatcctccccacacatctgaggacacacaaccacttggtacattttctcagatgttaagcttatttttataaaccacattgtacgtgtcacttttatttggcattttatacttaactagttgtatttatttttcatgtcatgagagtttccatataatgtgccataactgcatagacagcacgtcttcagggtgtggtttctaagcagaaaatagcaaatgtttatattgaataaaattgcatgttcctccacgc

SEQ ID NO: 595 - DNA, 8020 bp, Homo sapiens
cagtgatgagttctagaaggaaagaaaaggctgatgtgacagtgaggaagggatgagtggagacttctctgagacttcagtgattcctcttcctctgagctgagccaagctgagaagctgagaagagtaagatagggccgggaactcaggtccgttagtccgtcctccgaggtggggcgggccagcagaatggatttccgatctactctgtgagagcctcgcccaagaaagcccagagccacttccaagatccgcgctcccacggcgatgagaagcgttttcccccgggactgcttggcttaggactggggacccactggctttggagtaagccctggcacgggcctcgagggaagaaagaactcccgcgctccccacactccacagggcctgcgatcatctcagatgttccggttccacgtgcagaaaccccgccggtccgaggccccggttctaaaacggccctaagagtcaaggcttccacagctcgcctctgagggtggcaaagaggccgcgggggcggtgcctcgcgagacccaaacaagcccacgtggcaggggcggggctccgcgaaggcgtcacggcgcgctcgtgcgctgctgaggtcacgcgccggcagtacccttgcccgggggccgtaaagcgcggaaggtcgcggtctcggcttccccggaactttttgctcgcttcgccccgcccccttcccatccccgaaccccgctttccggcccgcggcgaccccaggcaactgttgtggctgccgcattgctcccgccgggctgtagctgagcgcggagcccgtggggaccggtgagatggaactgttttcccgcgttgagacgtgcggtccgcttgtgcttttagaactaaagactgctgcagagtccggaggaagaagtcacctagaaaaatctgggacagggcatttgagttcctgagatctagttggtgagagacatgatgttctaccggttgctgtcgattgttggaagacaaagagccagcccaggatggcagaactggtcctctgcaagaaacagcacgtcagctgccgaggcgcgttccatggccctgcccacccaggcacaggtggtcatctgtggaggtggaatcacgggcacttctgtggcctatcacctctccaaaatggggtggaaggatattgtccttttggagcagggcaggctggctgctggctctaccaggttctgtgctggcatcctgagcactgccaggcacttgaccattgagcagaagatggcagactactcaaacaaactctactatcagttagagcaagaaacagggatccaaacaggttacacaaggacaggctcaatctttctggcccaaactcaggaccgactgatctccctgaagcgcatcaacgcagggctgaatgttataggtatcccttctgagatcatctcccccaagaaagtggccgagcttcaccatctcctcaacgtgcacgacctggtgggggccatgcatgttcccgaggatgcagtggtgtcttccgctgacgtggctcttgccctggcaagtgctgcctcccaaaatggtgttcagatctatgaccggacatctgttcttcatgtaatggtcaaaaaaggtcaagttactggagtggagaccgataaaggacagattgaatgccagtattttgtcaactgtgctggccagtgggcatacgagctgggtctgtccaacgaggagccggttagtatcccgctacatgcctgcgaacacttctacctcctgactcgccccttggagacccctctgcagagcagcacaccaactattgtggatgctgatggaagaatttatattcggaactggcagggtggcatcctgtctgggggctttgagaagaacccgaaaccaattttcactgagggcaagaaccagctggagattcagaatctacaggaagactgggatcactttgagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaccttgccgaatggatggtacatggttatccctcagaaaacgtttgggaattggacctgaaacgttttggagccctccagagcagccgcacctttctgcgccaccgggtcatggaagtcatgcctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaaggacctcctggcattggagcagagcaagactttctataagccagattggtttgacatcgtggagtctgaagtcaagtgctgtaaggaagctgtgtgtgtcattgacatgtcctctttcacaaagtttgagataacatccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcagtttcttcatgatctctccaaccgaccagcaggtccactgttgggcctggcttaagaaacacatgccgaaagacagcaacctgctcctggaggacgtcacctggaagtacacagccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcctaaacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggcactagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctcaaaaaaaaaaaaaaaaaaatc

SEQ ID NO: 596 - DNA, 3260 bp, Homo sapiens
ccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttggaagtttcatcttttaatttggccagtgtttccttcatgctaatctagatgctgtggctgattacttgcccaggatctcctgtggcagcctctgcttgttctctggcttggagtggatggggcagcctccagctcctgtggaagtaatggaatagtggtggaaagggaacacagagagggaggcttccagtaagataggtgtgtaagcccagccatcatgtttggaatggcatgaggcagcagaggaggcctgagagctgctgctttggacttgggggtgggacagctcatctgagtattgccagccccctgtcctagtgcccacagcagaagggaatttgttaaataagcatggaccaaaatgccaacctctcggttgtgtatatgggtttgtgtcacaggactgtgacctgttctcggtgggtgcagtctgtgtagagtgcacatctgattattggtgggtcctgtgcctgtgcttaagcaagtcctgtggagaagtcatcatggagaattagtggtggccctagcgtgccacaaaacctggtctcatgagcatttgcaacatcccttttacatccttaatatccccttaccccacagtagccccaaacaaatgtgatctgaggtttagatcctcagtgaaaattgtggtttcaagtcttcatggccagcctcaaggcagttctagatgtgatcagcagtagtcacaaattcttgttttgtctccacacccagaaggcaagttttgtcagagctggggaataatttcagatatttgacatcttgattataaagggcttctgaacatctgtgtttactgcctttggaatacaaacaggtgcaactgagggactagctacactaccaccatttatctgtccaaggcaagagtatcaccaaggcctttgctccagccttacttggcatctttgcgcaagatagtcagagcaaacaatagtaatggacacttctcacacctggccaaggctgttggtacccacgaaatgacagcaaagatgagaggaaactgaattgcaagagcaatatgaaaccccaaccaagaggagtactctgcagttctttggctttggtatagagtggccactttctctaggacctggaagaagagtttgatggctaagaacgattgtgatcctaggtcttctttgtacgcatctccgtatttaggccagatctgcctcctgggaagggaaggggccaatgtcagcctccaggtgatttctttaatctgacattacaaagagaccaacagactgccaattctaccacattcccctggtgggtactcgactatgtagttttctctatgcttctggtcaactctgacacatcttggaattcttgtaataagaaaagaaatttttatacttttttctccttccctgagtcctgtggaccaaccctgaaatactaaaaacaagggcaataattaaagaa

SEQ ID NO: 597 - DNA, 3907 bp, Homo sapiens
aaagagcccgctccgccgagcgccgggcgacggcaggaagcccctccgcttggccagaatggagcagccgaagggagttgattggacagtcatcatcctgacctgccagtacaaggacagtgtccaggtctttcagagagaactggaagtgcggcagaagcgggagcagatccctgctgggacgctgttactggccgtggaggacccagagaagcgtgtgggcagcggaggagccaccctcaacgccctgctggtggctgctgaacacctgagtgcccgggcaggcttcactgtggtcacatccgatgtcctgcactcggcctggatcctcattctgcacatgggtcgagacttcccctttgatgactgtggcagggctttcacctgcctccccgtggagaaccccgaggcccccgtggaagccttggtctgcaacctggactgcctgctggacatcatgacctatcggctgggcccgggctccccgccaggcgtgtgggtctgcagcaccgacatgctgctgtctgttcctgcaaatcctggtatcagctgggacagcttccggggagccagagtgatcgccctcccagggagcccggcctacgctcagaatcatggcgtctacctaactgacccccagggccttgttttggacatttactaccagggcactgaggcagagattcagcggtgtgtcaggcctgatgggcgggtgccactggtctctggggttgtcttcttctctgtggagactgccgagcgcctcctagccacccacgtgagcccgcccctggatgcctgcacctacctaggcttggactccggagcccggcctgtccagctgtctctgttttttgacattctccactgcatggctgagaacgtgaccagggaggacttcctggtggggaggcccccagagttggggcaaggcgatgcagatgtagcgggttatctgcagagcgcccgggcccagctgtggagggagcttcgcgatcagccccttaccatggcctatgtctccagcggcagctacagctacatgacctcctcagccagtgagttcctgctcagcctcacactccccggggctcctggggcccagattgtgcactcccaggtggaggagcagcagcttctggcggccgggagctctgtggtcagctgcctgctggagggccctgtccagctgggtcctgggagcgtcctgcagcactgccacctgcagggccccattcacataggcgctggctgcttggtgactggcctggatacagcccactccaaggccctgcatggccgggagctgcgtgaccttgtcctgcagggacaccacacgcggctacacggctccccgggccacgccttcaccctcgttggccgtctggacagctgggagagacagggggcaggcacatatctcaacgtgccctggagtgaattcttcaagaggacaggtgttcgagcctgggacctgtgggaccctgagacgctgcccgcagagtactgccttcccagcgcccgcctctttcctgtgctccacccctcgagggagctgggaccccaggacctgctgtggatgctggaccaccaggaggatgggggcgaggccctgcgagcctggcgggcctcctggcgcctgtcctgggagcagctgcagccgtgcctggatcgggctgccacgctggcctctcgccgggacctgttcttccgccaggccctgcataaggcgcggcacgtgctggaggcccggcaggacctcagcctgcgcccgctgatctgggctgctgtccgcgagggctgccccgggcccctgctggccacgctggaccaggttgcagctggggcaggagaccctggtgtggcggcacgggcactggcctgtgtggcggacgtcctgggctgcatggcagagggccgtgggggcttgcggagcgggccagctgccaaccctgagtggatgcggcccttctcatacctggagtgtggagacctggcagcgggcgtggaggcgcttgcccaggagagggacaagtggctaagcaggccagccttgctggtgcgagcggcccgccactatgagggggctggtcagatcctgatccgccaggctgtgatgtcagcccagcactttgtctccacagagcaggtggaactgccgggacctgggcagtgggtggtggctgagtgcccggcccgtgtggatttctctgggggctggagtgacacgccaccccttgcctatgagcttggcggggctgtgctgggcctggctgtgcgagtggacggccgccggcccatcggagccagggcacgccgcatcccggagcctgagctgtggctggcggtggggcctcggcaggatgagatgactgtgaagatagtgtgccggtgcctggctgacctgcgggactactgccagcctcatgccccaggggccctgctgaaggcggccttcatctgtgcagggatcgtgcatgtccactcggaactccagctgagtgagcagctgctccgcaccttcgggggcggctttgagctgcacacctggtctgagctgccccacggctctggcctgggcaccagcagcatcctggcaggcactgccctggctgccttgcagcgagccgcaggccgggtggtgggcacggaagccctgatccacgcagtgctgcacctggagcaggtgctcaccactggaggtggctggcaggaccaagtaggtggcctaatgcctggcatcaaggtggggcgctcccgggctcagctgccactgaaggtggaggtagaagaggtcacggtgcctgagggctttgtccagaagctcaatgaccacctgctcttggtgtacactggcaagacccgcctggctcggaacctgctgcaggatgtgctgaggagctggtatgcccgacttcctgctgtggtgcagaatgcccacagcctggtacggcaaactgaggagtgtgctgaaggcttccgccaaggaagcctgcctctgctgggccagtgcctgacctcgtactgggagcagaagaagctcatggctccaggctgtgagcccctgactgtgcggcgtatgatggatgtcctggccccccacgtgcatggccagagcctggctggggcaggcggtggaggctttctctatctgttgaccaaggagccacagcaaaaggaggccttggaggcggtgctggccaagaccgagggccttgggaattacagcatccacctggttgaagtggacactcagggcctgagcctgaagctgctggggaccgaggcctcaacctgttgccctttcccatgaagctggcttctctctgcaacaggagaaaacctggagctacagtgtcccccaccttccttgccccatgggaacctccacctcctactccccacccacctctgcgaatctgctcccaaaggaagctgaccagagcaagatctgggcaagcagagagtgcctgggacaggactgtgacctggtggacaggggcctagatgtagcctctgttcctcctggacataggaaggtcccaagcttagtatcccacgtggcctttacaaatcctatggctggccttctcattccacaagggccctggaaagggttgacagccagccttggcatatggctgggagtcccttagcaaggccaaccctgaagaggccctttgaggcattccctatggcttagagttgtagacttacactcaaccctcatgtgagcgtgggagtgagggtggcggtcccttgccaagttggtagcagtgacccagtgattcactgccatcccaggccttaactagcaaaactacggagcgtgccaagtgacctggtgcctgtgggaagtgggttctcaggactggcattcttggaataaattcactctgtccttgca

SEQ ID NO: 598 - DNA, 4564 bp, Homo sapiens
aagatttgggggtcgccttgccggcctcctgtcctcctccggcggcggcggagcccgagagaactaggtgaacaccgctttgccagcctcacacagcgtcccctggctctgccgccgctccggacgtcgccctcccgttctgcttgggtccccttagtcgctacctttgctgggatccccctcctccatcctgtggcttcgggttgccgaagagcgatgctcggagggcggccggaagtggcgttggccgccattggcctgccggccagccaccttgctgtcctccgccgccttccgggtgttacatgcagccgggctcggcccctccccctggccggatggatccgtcggcgccacagccccgcgcggaaacctcaggcaaagacatatggcatccaggagaaagatgtcttgccccttctccagataatggaaaactttgtgaagcaagcataaaatctatcacagtggatgaaaatggcaagtcatttgcagtcgtcttatatgcagattttcaagaaaggaaaatacctcttaaacagcttcaagaagtgaaatttgttaaagattgccctaggaatcttatatttgatgatgaagatttagaaaaaccttatttcccaaaccgaaaatttccatcatcttctgttgcttttaaattatctgacaatggagactctattccttataccatcaataggtatttgagagactaccaaagagaaggaacccggtttctttatggacactacatccatggaggagggtgcattctgggtgatgacatgggacttggaaaaacagtacaggttatttcatttctggctgcagttttgcataaaaagggaactcgtgaggatattgaaaataacatgccagagtttttactaagaagtatgaaaaaggaacccctttcttctacagcaaaaaagatgttcttaatagttgctcctctttctgtcctctacaactggaaggatgaattggacacctggggatatttcagagtcactgttttacatggaaacagaaaagataatgaattaattcgtgtaaagcagaggaaatgtgaaattgctctaacaacttatgaaacactacgcttatgcctggatgaacttaacagtttggaatggtcagctgtcattgtggatgaagctcatagaatcaagaatccaaaagctagagtaacagaagttatgaaagctttgaaatgtaatgtccgcattggcctcactggaaccatccttcagaacaacatgaaggaactgtggtgtgttatggactgggctgtgccaggccttttagggagtgggacctacttcaagaagcagttttctgacccagtagaacatggtcagagacacacggcaacaaagagagaactagccactggccgaaaggccatgcaaagacttgccaaaaagatgtctggctggtttctcaggcgcaccaagactcttatcaaggatcagttgcctaagaaggaagaccggatggtgtattgttctttgacagatttccagaaagctgtctatcaaacagtgttagaaacagaggacgtgactttgatacttcaatcttctgagccttgtacctgtaggagtggccaaaaaaggagaaattgttgttataagaccaattctcatggtgaaacagtgaaaaccttgtatctcagttaccttacagtccttcagaaggtagctaaccatgtcgcgctactgcaagctgctagtacttccaaacaacaggaaacacttatcaaaaggatatgtgatcaggtattttccagattcccagattttgtgcagaaaagcaaagatgcagcctttgaaacactttctgaccctaaatacagtggaaaaatgaaggtccttcagcagcttttaaatcattgcaggaaaaacagagataaagttcttctcttttctttttccaccaagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaatggctggtggactaggcctcaattttgtcggtgccaatgttgttgtattatttgatcctacttggaatccagccaatgatcttcaagccattgacagagcatataggattggacaatgtagagatgtcaaagtgcttaggctgatatccttgggaactgtggaggaaatcatgtatttacgacagatatacaagcagcaacttcactgtgtggtggttggaagtgaaaatgccaaacgatattttgaagcagttcaaggatctaaagagcatcaaggagagctttttgggatccataacctcttcaaatttaggtcccaagggtcttgtcttacgaaggacatcctggaggtgtgaacttcttctctgaccttttcaataatattttaaatacagtttttcttcctcaggaaatctgaaatacaattgctgttgccttttcagagaaacttttggttttctttatcaaaaatgccttggaatttttacttttagagaataagaaatgaattattgtacctctaaactaagattttcccatgcataattacaaataatgcacacacacaaatgtatatgctgggtagtatgaactccaaggcaattttaaataggcagagagaagtttatagttttgaaaacagctgctgaagtcaggaactaaaaaaagaggttttcctaaataaacaaaaatataaaatgtgttttaattaaaagttaccaaatactccctgagatgtactctcatgtctcatggagatttttgttttctgttcccaataaaaattccacaccagtattttaaactctccctgttgtgttcatcctcagcatacagatgtttcttattcctcaaacaaaatattttatatccttttttaaaaaaatctttaagttcttttatataccggaatactaaggatattaacctattttctaattgatattcatataggtatcataaaatcctggagtatcatctttttcaacctcctcatggtatagatgaggaaactgagtcttagagaacttcaggatatttctcttgacttccaggactttgtagtaaaatcttaatgtacttcatttattcagtaagtaccataaaggcagttcaaggagcaattggttcctgtccttgaggaacttaaaccatcttgaccggaggtggaagagaacgtttacataataaccatgcaatgtcaggaatcgtatgctgaacaagttaaacagtagaccatggatggctgggggagaggaaggtatatattatttgaatcctataaatgttgttactattatacagtttctgatatatactgctgagtttctattttatagtaactatatttgattctgaattcagtggcccatttggagtcctactttttggggttttttccccttgctttttaaatacgctgtttctttcatgaatttgttctttccagtttcccttttcatatcaataactttgtttgccctccagctcccaaacccagctgctacctccatctcagagtactacttgacatgcctatattgatgttaaagtcaattgtctataaaaatattagcattttattatttatcctgttttctgtcatatatgacatagttacctgtttttatcagaataaccacctatttctttgttaaacaagtgttatataagacatatcaggatgacaggttattaagtagaaaaagttcccttgtttatcgtgccactgcactccagcctggggaacaaagcaagagacttgtctcaaaaacaaaaaacaaaaacaaaaaaaagttctcttgttcactggttattctaagaatatcttgtttcaccttcagaagtgtttattaatgacaggaccatccatgtcttacattttcttttttaaaaatatcttttaagttctttaatataccagaacactaagaatattaacctattttctaattgatattaataaggggtgacaaggccatccatgccctacatttgtcttgctaggcatatcattggcacttgattattaagttaaattttgaattaaaattactcatttgtcatcaatcagaatgtaaatttattcaggattggttagattcatgctgctttgggccaaaaggtgcttctaaatattattattagccccatataatgggagtacctatcataaagtaaaaggagtatttcacttcatgtgagacatttttaatttttaaaggttgtataaaatctcttttaaaatgttttaagatgtaaaaatttgaatatttacacttataatcttatgatttctgggcaatttcattctgttttgcattgactttccattatctatattatggtttctcttcaaagatagatattgagagttcattttacaagtatttgttgagcatctgctaaatgtcaggtactgttcatagagctttgcatacataaaagaacaaaataaacaaaacgatcctgtcta

SEQ ID NO: 599 - DNA, 2586 bp, Homo sapiens
gttttccggagactgttagaggaagagtcgctttttcctgcctcccaggctgcccagcggcgccggttgccggggaacgcaggcgccgtggggagggatggcgggaggatactgcttaggtgctggagacggagttgagctggtgaagaagagctcgggctcatcatgaaacaacgaaaaggccaagggtctgggggcagccgtgggcgcaaaaaaagaggtttaagtgacatttctccatctacaagcctgccacctctggttgaaggccagctacgctgttttctaaaacttactgttaatagagtcatatggaagattgcaaagcctcccacttgtgtacttgtccgagtgagatggtggggagaaacatcagatggaaccctcttttgtcccagggatgcattgcagactgaaccaaaagctgtgagaacaactacacgttacgctattcgttgtggtccaaaacagtttacctcttatctaacagatatggctgtgctggtgctggaagtaatcaccaaacttgatggtcttccaattggtagagttcagatcaatggactagctcaactttctccaacccatcaaatcaatggattttttaccattgtttcatcaacgtctaagaaacttggagaactccaggtctcacttgccctggaacctctgtcagaaacttacgacagctaccatccacttcctaccactgacatgacagaaaatgtgcttttatctaagcagggattcagagagaatactgaacccagcagtacccagtttcaggttccatcaaggcctcgcgacatacataccatcaaaattgatggaaaagagttagcagccaacagcagtagatcaaccactccgaggggaaaagaccatgtatgctttgcagagaaccctgatacaataaaggattcttcctttggactacagcacagtcttaattcaggacagagtttagagtctgtaactctgaaaggcagagctccacggaagcagatgtcccttctgaacagttctgaattccagcctcaaattagaacagttgccaagagtcacagtgactcatgcattctttcttcaaacaacctccctaccaaggatcttctttcagctctgttagaacaaggcaataaactgcgtaatgccatggtgatttctgcaatgaaatcaagcccagagaccagcatgttgttggaccaagttcatcctctattaatgaagattctcttagagcatcaacacagatcagagccttttctaggaatcggtttaaagaccacattgaagatcacctcctcccttcaactgagaatacattttggagacatgacacaaaagctgataccagagctatacagctgctattaggcagtgctgaattatcccaaggcaatttctgggatgggctaggctctcctccagattccccatctcctgggagtgatgtgtattgcatcagtgagctgaatgaccctcagtatgaccagagtcttctggagaatttattttatacagcacctaaatctgataccagcatcagtgatttcctcagtgaagaggatgatatcgtcccttctaaaaaaataagccagtcaacagctcttgccagatcatctaaggttctggagtcaagtgatcataagctgaagaagaggtcagcaggcaagagaaatagaaatttggttgaacaacagatgctctcagaaactccagaagatgcccaaacgatgacactaagtgtggatagactggcccttttgggtagaacacattcagtcagaatcatcatcgaaaccatgggagttcctccagatagtcctcagatgacccctggcaaaaaaagctatgctggtccaccacctaaggtgactacagcaaaaaagcgcactttctttgtagaatatcactttcctgtgggcttttcggaaagcggattgggaaagacagctttgatcactgaggttgttcgactcgcctccagtaaaattacagatggaagtaagagacacactggttttctgcaccttagacattctgactttggaagaatttttgaattcctaattactcatttgactttttttttttttttttttttgacatggagtctcactctttcgcccaggctggagtgtggtggcgcaatctctgctcactgcagcctccacctcccgggttcaagtgattctcccatctcagcctcctgagtagctgggattacaggcgtatgccaccacacccagctaatttttgtattttttagtagagacagggtttcaccatgttggccagggtggtctcaaacccctgaccttaagtgatccgcctgcctcggcctcccaaagtgctgggattacaggcataagccatcacgcccagccaatattttcaaggctgtgcaaccatcaccacaatctaattttagaacattttcatcccccctaaaagaaaccccatacttactagcattcgcttcgcatttccctcttcccccagccctaagcaactgctaatctttctttccctatcaatttgtccattctggatgtctcatataaatggaatcatgcaacttgt

SEQ ID NO: 600 - DNA, 4716 bp, Homo sapiens
aggcggctgggcgatgcgcttgcgcactgagaactcacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagatgacaatgaaggagacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacaaagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagatggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaaccaagcttctgcagattttgtgattcttgggacttttttgacgtaagaaatacttctttatttatgcatattcttcccacagtgatttttccagcattcttctgccatatgcctttagggcttttataaaatagaaaattaggcattctgatatttctttagctgctttgtgtgaaaccatggtgtaaaagcacagctggctgctttttactgcttgtgtagtcacgagtccattgtaatcatcacaattctaaaccaaactaccaataaagaaaacagacatccaccagtaagcaagctctgttaggcttccatgttagtgtagcttctctcccacaagttgtcctcctaggacaagaattatcttacaaactaaactatcatcacactaccttgtatgccagcacctggtaacagtagagatttttatacattaatcttgatctgttttaatcttgatctgttttagtagagatttttatacattaa

SEQ ID NO: 601 - DNA, 685 bp, Homo sapiens
ggcggggcctgctgggtggcttagcactgcagggctctgcgcgggaacgctaacctggtccggagcgagtctgggtctcagccccgcgaacagcctttcacgagtcttcaagctttcaggctatcttctagtcaagatgagtgataagccagacttgtcggaagtggagaagtttgacaggtcaaaactgaagaaaactaatactgaagaaaaaaatactcttccctcaaaggaaactatccagcaagagaaagagtgtgttcaaacatcataaaatggggatcgcctcccaacagcagatttcgacattacctgagagtcttgattttaggcttgttttttgtaaacccatgtgtttgtagagattttaggcgtcttcggatatcttctcacctatgttccctggctaagaagtcagaggtagccaatgtttccttaaattcatttttaaacttaccattggtgcatatgttccagatggcagatgctgtcaataatctcaccattgatgacctttgtgtatgtagttcttgcatcctatactggataagcctgttttaacctgctatgatgggtgcttccattgcttcataatcttcatgaagttgcatgcttttgcagcttttcacagtttatttgcatttctaatgtagtaataaagtaaccaatataatcattatcttga

SEQ ID NO: 602 - DNA, 2599 bp, Homo sapiens
cctcgctttcgctgggcgctgtccctctccgcggcggtctggtttccccgacgtgttttgtttgcgacgctgtcgtgtaacagcgcgctttacggccgcggggacggagcgagccggcgccagggcccctcgggccgggaagaggggaaggggagcgaggttgatgcccggcggaggggcgagcgcggcgtctggccggcttctcaccgccgcggagcaaagagggtcccgggaagcggcagggtcggcgtccaggagcggcttcgggggctccggcggcggcagaggcggagcaagcggccccgggtccgggagcggaggcccggggggccccgcgggcaggatgagcttgaccccgaaggagctctcgagcctgctgagcatcatatcggaggaggcgggcggcggcagcaccttcgagggcctgtccaccgccttccaccactacttcagcaaggccgaccacttccgcctgggctcggtgctcgtcatgctgctccagcagcccgacctgctgcctagcgcggcgcagcgcctcacggcgctctacctgctctgggagatgtaccgcaccgagccgctggccgccaaccccttcgccgccagcttcgcgcacctgctcaaccccgcgccgcccgcccgcggcggccaggaacccgaccgccctccgctctcaggatttttacctcctataactccaccagaaaagttttttctttcccagctgatgctggcacccccacgggaactcttcaaaaagacgcctcgccagattgcactgatggacgttggaaacatgggccagtctgtggacattagtgggcttcagttagccttggccgaacgccaatctgaattgccaacgcaaagcaaagcgagcttccccagtattctcagtgacccagacccggattcttctaattctggatttgacagctcagttgcctctcagatcacagaagctttagtcagcggaccaaagccacctattgaaagccattttcgaccagagtttattcgtccaccgcctccactccacatttgtgaggatgaacttgcttggctaaaccccacggagcctgaccacgcgatccagtgggataaatcgatgtgtgttaagaatagcactggtgtggagatcaaacgaataatggccaaagccttcaaaagccccttatcctctccccaacaaacacagctacttggtgagttggaaaaagaccccaaacttgtctaccatattggcctcaccccagccaaacttcctgaccttgtggaaaacaaccctttagtcgctatagaaatgttgctgaaattaatgcagtcaagccagatcactgagtatttctctgtcctggtcaatatggacatgtctttacattcaatggaagttgtaaatcgactaactacagctgttgatctacctcctgaatttattcacctttatatatcaaattgcatctctacttgtgaacagattaaggataaatatatgcagaatcggttggtgcgtcttgtgtgtgtgtttctccaatccttgatccgtaacaaaattattaatgtacaggatttgtttatagaagtgcaggcattctgtattgaattcagtaggatacgagaagctgctggtcttttccggttgttgaagacattggatactggggaaacaccttctgagaccaaaatgtcaaaataatacctcatcagaaccatcccatccattcactgttcagctgtactgtgatttagtttttacaccgttaaaaccctgagtggattgcttggtttaatgcatataaacagtactttatctacttaaagcaaagttttgctttcttgaatgactttttctgtgagatgaatttttgataagaactagggaaaacatgtcttttaggtgtcttgctgatgactatccataggaggaatggctatcccaaaaaaagttccgcaaaaaagtagatgagtttcttttttttttaagcactaaagaacaaaatgcatttttcattaatacaggcttctgatgaaccaggaatcctgttttcgtaaagttccaatgttgatgagagtaaattcttaagcatttgtcctagaggtgaaagcagctgaatgtttctgaaccatcaagaggcaaacaaacaggagtttgtttcttgaacctgcttatgcacacagctcttaactcctcatgaggcacacagctcttaactcctgatgaaccaaggatttactcataactttctccttgtcatggaggcttaatagacaacagaataaatgcatttcttgggcctcttataaacttgggaattcttagaaagctgcttctattaccaggctgtaatagctggtatagttttttttttttctcttaagatgttctgttattagtctgagacagccatttttttgttttaaggaaaaatatcagtcagtgctccgggaggtaatttcctgtggggtctgcaccctcctgtctgggtggtggatgtgggtttgagaagtaggagagcagggtggtaccgtgtgggctcttaccctttatgtgattttggacaacagtgccttccattaaagttctttttatcaactgtta

SEQ ID NO: 603 - DNA, 3301 bp, Homo sapiens
gcgcgggccgggccgggcggcggcggcggcaccatgagcggccggaagcgcagcttcaccttcggggcctacggcggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtacccaga

SEQ ID NO: 604 - DNA, 1692 bp, Homo sapiens
tggagactgaaagcggcggaagggacgctggaatgtggagcggttgtggggcggcagctgcggaactgcgcgattgtggttcccgccgtatttcccgttccccatctagtaactcccatctcagcccacgtatctccctgagtggaaatctcgggccccagaccagtcgattgggaggtccgccctccccttcagcgacttggtctgtgttttggcagttgccgcgacaacagtcacttccgggaaggggctctgcgaatctccttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagctccaaatgagaagatgaagcaagtgttaaagaagactatagaagaagccaaagcaataatatctaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaaggggacagggagctccagcccgagagcctattattagcagtgaggagcagaagcagctgatgctgtactatcacagaagacaagaggagctcaagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaaggttttagaacttaataaatacctagtcagaagaaaa

SEQ ID NO: 605 - DNA, 1161 bp, Homo sapiens
gagaggcccaagatggagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccagctgccggtagtagaggaggtagtgatggaaccccccgggggagccccagcccagccagcgtgtcctcggggaggaagtccccacattccaagtcaccagcagagcagcgcgagcggaagtccttggccgatgacaagaagaaagtgaagaacctggggtaccgggactcaggctattactgggaggtaccacccagtgaggtgcagctgctgaagaggatcgggacgggctcgtttggcaccgtgtttcgagggcggtggcatggcgatgtggccgtgaaggtgctcaaggtgtcccagcccacagctgagcaggcccaggctttcaagaatgagatgcaggtgctcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtg

SEQ ID NO: 606 - DNA, 2410 bp, Homo sapiens
agcgcgagccccgccgccgccgagcatggacgaccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccagggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaaggaaaggagtgcccgtcggcgtcttggtcctcctgtccctgctgcaggggctggggcctccggagctgctgcgggctcccctcaggctctgcttcgtgacccgtgacccatgacccacagtgctggcctcctgtggggccactatagcagccaccagaagccgcgaggccctcagggaagcccaaggcctgcagaagcctcctggcctggctgtgtcttccccacccagctctcccctgcgcccctgtctttgtaaattgacccttctggagtggggggcggcgggcagggctgcttttcttagtctgataccaagcaaggccttttctgaataaattcatttgactttga

SEQ ID NO: 607 - DNA, 1099 bp, Homo sapiens
ccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgactgaaagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgttggggcccctcattggggtccaggtgcccgaggagaaggtggaacgcaacaggactgccatggaccaggccctgcaatggctggaggacaagttcctgggggacaggcccttcctcgctggccagcaggtgacactggctgatctcatggccctggaggagctgatgcagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaa

SEQ ID NO: 608 - DNA, 1089 bp, Homo sapiens
cccgggagccggcagggagcggagctgcggagccgcctggtctcccgcgtccatcggtccattcctgcgtcgttctgtccttccgaacgcacacttcaggagcagccgcgaggagtgagcactgcacgcaggatccgcccagtgcttgggccaagcaccctgtggcatccaagctcccctggacgttacccttggtgaaccaaggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaag

SEQ ID NO: 609 - DNA, 1430 bp, Homo sapiens
tggctcctcccgcttcgtccgcgtcgcctgtccccgctccccatcttccgggctgggagggaggcgggaccggccgcgtctccatggcgacgcgggacgcggcggtggaggcggttgctacccacctgctagaggcgctgcggctgtgatccaggctggggcgagaccatgtcggacctgggctcggaggagttggaggaggagggagagaatgatattggggaatatgaggggggtcggaatgaggcaggcgaaaggcacggacgtgggagggcacggctacccaacggggacacctacgaagggagctacgaattcggtaaaagacatggccaggggatctacaaatttaaaaatggtgctcgatatatcggagaatatgttagaaataaaaagcacggtcaaggcacttttatatatccagatggatccagatatgaaggagagtgggcaaatgacctgcggcacggccatggcgtatactactacatcaataatgacacctacactggagagtggtttgctcatcaaaggcatgggcaaggcacctatttatacgcggagacgggcagtaagtatgttggcacctgggtgaacggacagcaggagggcacggccgagctcattcacctgaaccacaggtaccagggcaagttcttgaacaaaaatcctgttggccctggaaagtatgtatttgatgttgggtgtgaacaacatggtgaatatcgtttaacagatatggaaagaggagaagaggaagaggaggaagaattagtaactgttgttccaaaatggaaagctacccaaatcactgaattggccctgtggacaccaactctccccaaaaagccgacctctacggatggacctggccaagacgctccaggagctgagagtgcaggagaacccggggaggaggcccaggctctgctggagggcttcgagggtgagatggacatgaggcctggagatgaagatgcagacgtcctccgggaagagagccgggagtatgaccaggaggagttccgctatgacatggatgagggaaacattaattctgaagaagaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttgattgacaaatgcaaataaacgtctttattatcctttctttctgaaa

SEQ ID NO: 610 - DNA, 6113 bp, Homo sapiens
taatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaacatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtc

SEQ ID NO: 611 - DNA, 3934 bp, Homo sapiens
gtctcgtgtttctctcttccaatcggttgtctttatcgtggacactgaggtgttctctgccttgactaaagatgagtgacgtgaatccaccctctgacacccccattcccttttcatcctcctccactcacagttctcatattccgccctggacattctcttgctaccccggctccccatgtgaaaatggggtcatgctgtacatgagaaacgtgagccatgaggagctacaacggttcaagcagctcttactgactgagctcagtactggcaccatgcccatcacctgggaccaggtcgagacagccagctgggcagaggtggttcatctcttgatagagcgtttccctggacgacgcgcttgggatgtgacttcgaacatctttgccattatgaactgtgataaaatgtgtgttgtagtccgcagagagataaatgccattctgcctaccttggaaccagaggacttgaatgtgggagaaacacaggtgaatctggaggaaggagaatctggtaaaatacggcggtataaatcgaatgtgatggaaaagtttttccccatatgggacattacgacttggcctggaaaccagagggacttcttctaccaaggtgtacacaggcacgaggagtacttaccatgtctgcttctgcccaaaagaccccagggtagacagcccaagaccgtggccatacagggagctcctgggatcggaaaaacaatcctggccaaaaaggtgatgtttgagtgggccagaaacaagttctacgcccacaagcgctggtgtgctttctacttccattgccaagaggtgaaccagacgacagaccagagcttctccgagctgattgagcaaaagtggcctggatctcaggacctcgtgtcaaagattatgtccaaacccgaccaacttctgctgctcttggatggctttgaggagctcacatctaccctcattgacagactggaggacctgagtgaagactggaggcagaaattgcctgggtctgtcctactgagcagtttgctgagcaaaacgatgcttccagaggccacgctactgatcatgataagatttacctcttggcagacatgcaagcccttgctgaaatgtccctctctcgtaacccttccggggtttaatacgatggaaaaaatcaagtatttccagatgtattttggacacacagaggagggagaccaagtcttgagtttcgccatggaaaacaccattctcttctccatgtgccgggtccctgtggtttgctggatggtctgctctggtctgaaacagcaaatggagagaggaaacaatctcacacagtcatgtccaaatgccacctctgtgttcgtccggtatatttctagcttgtttcccaccagagctgagaacttttccagaaagatccaccaagcacaactggaaggtctgtgtcacttggccgcagacagcatgtggcacaggaaatgggtgttaggtaaagaagatcttgaggaagccaagctggatcagacgggagtcaccgccttccttggcatgagtattcttcggagaattgcaggtgaggaagaccactatgtctttaccctcgtgacttttcaggaattttttgcggccttgttttatgttctctgtttcccacaaagactcaaaaattttcatgtgttgagccacgtgaatatccagcgcctgatagcgagtcccagaggaagcaaaagctatctctctcacatgggacttttcttattcggttttctgaacgaggcctgcgcttcggccgtggaacagtcattccaatgcaaggtgtctttcggtaataagaggaaactgctgaaagtcatacctctgttgcataaatgtgacccaccttctccgggcagtggggtcccgcagttattctactgtctgcatgaaatccgggaggaagcctttgtaagccaagccctaaatgattatcataaagttgtcttgagaattggcaacaacaaagaagttcaagtgtctgctttttgcctgaagcggtgtcaatatttgcatgaggtggaactgaccgtcaccctgaacttcatgaacgtgtggaagctcagctccagctcccatcctggctctgaagcgccagagagcaatgggctgcatcgttggtggcaagacttatgctctgtgtttgcaacgaatgataagctggaagtcctgactatgaccaacagtgttttggggcctccttttttgaaggctctcgcggccgcactgaggcaccctcagtgcaaactgcaaaagctactcctaaggcgtgtgaatagcaccatgttgaaccaggacttaatcggtgttttgacggggaaccagcatctgagatacttggaaatacaacatgtggaagtggagtccaaagctgtgaagcttctatgcagggtgctgagatccccccggtgccgtctgcagtgtctcaggttggaagactgcttggccacccctagaatttggactgatcttggcaataatcttcaaggtaacgggcatctaaagactctcatactaagaaaaaactccctggagaactgtggggcgtattacctgtctgtggcccagctggagaggctgtcgatagagaactgcaaccttacacagcttacttgtgaaagccttgcctcctgtctcaggcagagtaagatgctgacccacctgagcttggcagaaaacgccttgaaagatgaaggggccaagcatatttggaatgccctgccacacctgagatgtcctctgcagaggctggtactgagaaagtgtgacttgacctttaattgctgtcaggatatgatctctgcgctctgtaaaaataaaaccctgaaaagtcttgacctaagttttaatagcctgaaggatgatggggtgatcctgctgtgtgaggccctgaagaaccctgactgtacattacagatcctggagctggaaaactgcctgttcacctccatctgctgccaggccatggcttccatgctccgcaaaaaccaacatctgagacatctggacttgagcaagaatgcgattggagtctatggtattctgaccttgtgcgaggccttctcaagccaaaagaagagagaagaggtcattttctgtattcctgcctggactcgaataactagcttctccccaactcctcacccacccgacttcacgggaaaaagtgactgcctatcccagattaatccttaggccgtccagtcatctttctctggggcttgattgatcagttcccactctgacaactggcaaataccaggcgttatcatcctgtatgcattaacgtactttcccctgaaacagagcaacccagtcaacaccacagaacctcagctttgaaccctggagtgaggacggtgatgccctgtgtgtattaatatgctatgtaaggctgggcgtggtggctcacgcctgtaacccagcactatgggaggtcgaggtgggcagattacctgaggtcaggagttccagaccagcctggccaacatggtgaaaccccgcctctactaaaaaaaaaaatacaaaaaattaggcgtggtggtgggctcctgtaatcccagctgctcgggaggctgaggcaggagaatcacttgaatctaggaggcagagtttgcagtgagctgagatcacgccattgcactccagcctgggcgacagagcaagactctgtctcaagaagaaaaaaaaaatacatatacacataaatatatatatgtgtgtgtgtatatatatatatatatatatatatgctatataaagtttaaatgaaatgctttgagtcacctaagacaggatatagacaaagtcttcatcgtcttcttgcttcttctacctttatttattctcagctctgaatgtatgaacctgctcaatcacctcatcttaaaaataaaatcactgtccctaga

SEQ ID NO: 612 - DNA, 6067 bp, Homo sapiens
cagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagagctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagcttgaacgtgaatcggttctcccctgctaactacgaccaggcgcatttacacccccatctgttttcggaccagtcccggggttcccccagcagctacagcccttcaacaggagtggggttctctccaacccaagccctgaaagtccctccacttgaccaattccccaccttccctcccagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatatattatatatataatatataatataatatattatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgct

SEQ ID NO: 613 - DNA, 5304 bp, Homo sapiens
gcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggagtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctg

SEQ ID NO: 614 - DNA, 2163 bp, Homo sapiens
ggatcctggaggtgggggctgtgccctgagggagggcacagggaaccgggatggggctgggggacagcgagtgctgggaagtgtgcgagatttcactccggggctcgggtcgagctaccccgtgcttcaggcggtcctgcgcctcctctccccaagacccttcggggacacagcactgcagacccgccggagacaacttgtgcgggagcccggagtcctcggaataacacttggtaagtgttaccgcgcccttcttcccttacgccagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaa

SEQ ID NO: 615 - DNA, 4487 bp, Homo sapiens
tggccgccgcggctgccgctgctgctgaggcggaggccgcggaggccgcggaggcggaggccgaggccccggcgcagcggggcgcgccccgggcccaggcccggccccagccgccgctgcggagcccgccgggaccccccggagcgcggccacggcgcagccgctgccatggcccagacactgcagatggagatcccgaacttcggcaacagcatcctggagtgcctcaatgaacagcggctgcagggcctgtactgtgacgtgtcagtggtggtcaagggccatgccttcaaggcccaccgggccgtgcttgctgccagcagctcctacttccgggacctgttcaacaacagccgcagcgccgtggtggagctgccggcggctgtgcagccccagtctttccagcagatcctcagcttctgctacacgggccggctgagcatgaacgtgggcgaccagttcctgctcatgtacacggctggcttcctgcagatccaggagatcatggagaagggcaccgagttcttcctcaaggtgagctccccgagctgcgactcccagggcctgcatgcggaggaggccccatcgtcggagccccagagccccgtggcgcagacatcgggctggccagcctgtagcaccccgctgcccctcgtgtcgcgggtgaagacggagcagcaggagtcggactccgtgcagtgcatgcccgtggccaagcggctgtgggacagtggccagaaggaggctgggggcggcggcaatggcagccgcaagatggccaagttctccacgccggacctggctgccaaccggcctcaccagcccccgccaccccaacaggctccggtggtggcagcagcccagcccgccgtggctgcgggagcagggcagccagccggtggggtggcagcagcagggggtgtggtgagtgggcccagcacgtcggagcggaccagcccaggcacctcaagcgcctacaccagcgacagccctggctcctaccacaatgaggaggacgaggaggaggatggtggcgaggagggcatggatgagcagtaccggcagatctgcaacatgtacaccatgtacagcatgatgaacgtcggccagacagccgagaaggtggaggccctcccggagcaggtagcccccgagtcccgaaatcgcatccgggttcggcaagacctggcgtctctcccggctgaacttatcaaccagattgggaaccgctgccaccccaagctctacgacgagggcgacccctctgagaagctggagctggtgacaggcaccaacgtgtacatcacaagggcgcagctgatgaactgccacgtcagcgcaggcacgcggcacaaggtcctactgcggcggctcctggcctccttctttgaccggaacacgctggccaacagctgcggcaccggcatccgctcttctaccaacgatccccgtcggaagcccctggacagccgcgtgctccacgctgtcaagtactactgccagaacttcgcccccaacttcaaggagagcgagatgaatgccatcgcggccgacatgtgcaccaacgcccgccgcgtcgtgcgcaagagctggatgcccaaggtcaaggtgctcaaggctgaggatgacgcctacaccaccttcatcagtgaaacgggcaagatcgagccggacatgatgggtgtggagcatggcttcgagaccgccagccacgagggcgaggcgggtccctcggctgaagccctgcagtaacccgcccagcctcccgcggggccacacacttcccctcccaacacacacacacacctgccatcttggtcatgagctactgtctgtccctccccaggacccgcggtgggtgctgcatgttcccggccctctgcccctcctgtcctaccccctttccccaccgagagctgggccgggagaggaccgcagggcaggtggcgtgaggtccgtgttgccttctttaacacacactcgtgcagtgggggagttctggctccccaacctaacccctagccgtcatctccacactcaccaggcccaccaggggagggggctggcctgggggtcttgggaaggcccctccccaggccctaggccacctcgcggaagccttcagcctccgcccctcactgcagccccttgggacttgaggggggccccaggggttctcaggacccctcccaccacctcccagtgcttccacgtctccaaaagcgccttcctgtcaccctcgtctatccctgcgcctgggggctggggtaggcgaggccgtggggactacccattttatagctggggaaacaggctccgagaaattgcacaaccgacctcaggtggccggcagtggcgtgcctggtgccctttctcctcttccgcctctgttgctccctttggtcctctggggcctcagagaggcaggtcctaaaggagggggggtctcctgggggcagaccgagggtctcggaggatagaatgagaggtttccagggctggcagagtgtgtgcgtgtgtgtgtgcagaagttttgctttcaaacaaatgaagatacaagaggcagtaggacctgggttggaacccaggggagcagactggggggctgttgcccctccctccatctccccacacccaccccaccccacagcagggctcctggcccccacccccctgtacataatttttaaaacctttttttagcgaatgaaatattgaagtataagattccttttatttttcaaaccaatggggctgtgtctattgtccccctcggtccccaggggtggggggccttggaaggcagggcggtgttggggggctggggggcaggctgaatgtgtgtgtgtgggtgtgtatgtgtggagtgtgtgtgtgtgtttccatggtaggactccagtcccagctgctgcctaggctcctgtgggtcctgtgggtccccctcccctgttcaccttccccaacagggctatagtttaagggtgtcccaggccttggctggttggctgggcccagctcctgggggctgggcagggcagggcagggccgggtccacttccattgttagcagttgtttgcagaattttctcttttaccattcctctctttttgttctcgcccagagtgggtggttttttgttgttgttttagattttcatgtgaaggcagttttttttcttttttaactccccatccccctatgcagggtgtcatttcaccatccacatccacatccttgtttgtgtttctggccctcgtcctccctgcctctcatctgcctccccaacccccacctacccactgctcccaggggtctctccaggggcagggggattttaggagatggggtgggggccagcccctactggacccttgtaatctgatttggagaccatccccccgatgggaccagcagccccgccggcccactgggggtccctcttaacatctgcttgttgcgggggtcagtcatgagtgccagggtctggctggggtcttggcactgtcttcctggccggggcctgaaaccttagcccccagccggcctgagtgggggatattgacacccccagctaaagcacaagcaccttagtcacccctcctctccccccgcctcctggcctgccaccccaccccagcgtttaccccaaagcacaatgccctggtcacttggcaagcggctgggcctgacggaggccgaggggcagaccggggctccagccagacccctgaaaggaaggtgctcccccacttccaggccttagttggggtgggggggccagctcctgggcctggggtcttctcacccccacccccttgtcctgggtaggcccctgcctgcccctctctgccttttcctcgggtgtccctcctcgagcccctgtggcattggcttgggtggcagagcccacttgtttcagggaccccaggaggtgccccctggctcccaggactgtgtgtgggtccggggggtgggggggtggggagaagggtcgggcagggggtgcaggggaggaaactcctcaccaggagagccaaagacagggttgtgccttaccccaggagccacccctgtaccccccttgccctgccattcaccctccacccctacccctgggcggcctgctgctttttccttctcttcctcccctgccctgagctgcatggttcccccaccctgggcagccaggaaggaatctgaatggagaatcaccaaccaccagagaaaaaagactgtggggccctcccctgccaactccccttccctggccgcccactcaacccacacctctttcacgcaggacaggctgcccaccctgtccacgtgaagtgccaacgccctccccaccctgggccgagcccccacccctccctgggcccccaagtgagattgcacatttaactactgtaaggagaggagcggcgttggcaaatgtgaaccatgagaatatcagtgatactgatgagaataaactaaacgcctttgt

SEQ ID NO: 616 - DNA, 2044 bp, Homo sapiens
ggtccgagttcggaatttcggttcaaggcccagttcctcggattgttcctgcgcaacttcagtttcccttccaggcacgggcaatgagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagt

SEQ ID NO: 617 - DNA, 1751 bp, Homo sapiens
gtacactgtctctacaggccaggaaagagttgtgtgtctttggggtcccttccgctccgcctagggttcccggccaggccgagagaccaagcagggaccatgcgcgtgttggtacccccggctgagcgcagccaggacacacgcgttggggccccagcatggcgcgaggcagctcaggccatggcgaggaccgcgcacattctgaccgatcgctgcgggcaggaggcggtgaccatgtggcagcccaaggacagcgtgctggacccgaacgtggcccaccacctcggccgcgccgcctacatccagccctggcgcttccgcgtggagatgatcaaaggcggcggcaccttggagaagccgccgccaggcgagggcgtcacgctgtggaagggcaagatgaagccgcccgcctggtacgcccgcctgccgctacccttgcaccgcaaagcgcgcgccctgcagaccaccgaggtggtgcacgcgcacgcgcgtggagcgcgcctcaccgccgcccgcctcggccgcgcgcagcaccagattaacgggcgggtgcgacagctgctgcgccagcgcgaggtcaccgaccacaggctcagcgaagtgcgcaagggtctgcttattaaccagcagagcgtcaagctgcggggctacaggcccaagtctgagaaggtccctgacaaagctgacagtatgcttacatgggagaaagaggagctgaaaagcatgaagaggaaaatggagagagatatggaaaaatcagaggtcctactcaagaccctggcctcctgccgagacactctgaacttctgcttcaaggagcggctccaagccgtggacctcatgaaccagcctctggacaaggttctggagcaggccagacgccactcatgggtgaacctctcccgagcccccactccacgcacacagggtcagaaaacgcctcctccagaccctgtgggcacctataacccagcgtgcgccttggcgctaaacgaagccaagcggttgttggtcgagtccaaggacaccttggtagaaatggcaaagaacgaggtggacgtccgggagcaacagctgcagataagcgaccgtgtgtgtgcctcgctggcgcagaaggcgagcgagaccttggagctgaaggaaagattaaatatgacgttaggactgatgaggggaactatcctccggtgtacgaaatataaccaagagttgtacaccacccacggtctcatcaagggtcctctgtcgaaagttcacctggagaccgcagaaaagctggacagacccctggttcgcatgtaccagagacacgtgggcacccaactcccggaggctgcgcgcctcgcacagggcaccgacaagctgcagtgccacatcacgtacctggaaaagaacctggacgagctgctcgccacgcacaagaacctcagctggggcctcaactgcaagaacatcgggcatgaggtggacggcaacgtggtgcgcctgcgcctgcgccagcggcaaccgcacgtgtgctacgagcaggcgcagcgcctggttaaggactgggacccgcgcacgccgccgccgcgcagcaagagcagcgcggacccctagtgaccccagcgtcccccgccccagccagctgattggatgctggctgggacctcggagagcagacacagccccatggccctccctctcccctgacgcaccctccctccaagcaccctctaggagaattataattaaaaataacaataattatc

SEQ ID NO: 618 - DNA, 2057 bp, Homo sapiens
actgcagggccaggattctggaacttgggttgcctgatagaccctatacaaaagatgtagtagggaaaaggagcgacagctggctaaaggggccccccacaaccctccccgacaccctaggaaagcagcctctctccgctgtcccagggtgccatggagatggagagcgcggcggcctccacacgtttccaccagcctcacatggagaggaagatgagtgcgatggcctgtgagatcttcaacgagcttagactagagggcaagctctgcgacgtggtcatcaaggtcaatggctttgagttcagtgcccataagaacatcctctgtagctgcagttcctactttagagctttgtttacaagtggctggaacaacactgaaaagaaggtatacaacatccctggcatttctcccgacatgatgaagctaatcattgagtatgcatacacccggaccgtgcctatcacaccggacaatgtggagaaactgcttgctgctgcagaccagtttaacatcatgggtatcgtcaggggttgctgcgagttcctcaagtcagagctgtgcttggataattgtatcggcatctgtaagttcacggactactactactgtcctgagctgaggcagaaggcctacatgttcatactgcacaactttgaggagatggtgaaagtctcggcagaatttttagagctctcggtcactgaacttaaggatatcattgagaaagatgagctcaatgtcaaacaggaagatgctgtatttgaggccattttaaagtggatttctcatgacccccaaaatagaaagcagcacatttcaattttgcttcctaaggttcgcctggccctaatgcatgctgagtacttcatgaacaatgttaagatgaatgactatgtcaaagacagtgaggaatgcaaaccagtcatcattaatgccctaaaggccatgtatgacctcaacatgaatggaccctctaattctgatttcaccaacccactcaccagaccacgcttgccctatgccatcctctttgcaattggtggctggagtggtgggagccccaccaatgccattgaggcatatgacgctcgggcagacagatgggtgaatgttacttgtgaggaagagagtccccgtgcctaccatggggcagcctatttgaaaggctatgtgtatatcattggggggtttgatagtgtagactatttcaatagtgttaagcgttttgacccagtcaagaaaacttggcatcaggtggccccgatgcactccagacgttgctatgtcagtgtgacagtcctcggcaattttatttatgccatgggaggatttgatggctacgtgcgtctaaacactgctgaacgttatgagccagagaccaatcaatggacactcatcgcccccatgcacgaacagaggagtgatgcaagcgccacaacactttatgggaaggtctacatatgtggtgggtttaatggaaacgagtgcctgttcacagcagaagtgtataacactgaaagtaatcagtggacagtcatagcacccatgagaagcaggaggagtggaataggcgtgattgcttatggagaacatgtatatgcggtaggtggctttgatggagctaatcgacttaggagtgccgaagcctacagccctgtggctaacacttggcgcacaatccccactatgtttaatcctcgtagcaattttggcatcgaggtggtggatgacctcttgtttgtggtgggtggctttaatggttttaccaccacctttaatgttgagtgctatgatgaaaagaccgatgagtggtatgatgctcatgacatgagtatataccgcagtgctctgagctgctgtgtagtaccagggctggccaatgttgaggaatatgcagctagacgggacaacttcccaggattagcactgcgagatgaagtaaaatattctgcttcgacaagtaccctacctgtatgagcctcttcatttagctaataaaaagtctaagcaataagaattaattctttttttaaaaaaatgcagtgtttaaactt

SEQ ID NO: 619 - DNA, 1765 bp, Homo sapiens
agatttgttgcaagctgtgggaggaaggagagttcttcttccaggtggtttcctgcagactgcctgctagggctcagaggaccagcttcttccctgctgtctcctgagcccagtccctcttggccatcacattccccttgccctatggcggccctcacagacctctcatttatgtatcgctggttcaagaactgcaatctggttggcaacctctcagagaagtacgtcttcatcacaggctgtgactctggcttcgggaacctgctggccaaacagctggttgatcggggcatgcaggtgctggctgcttgcttcactgaggagggatcccagaaacttcagcgggatacctcctatcggctgcagaccaccctactggatgtcaccaagagcgaaagcatcaaggcggcggcccagtgggtgagggacaaagtgggcgaacaaggcctctgggccctggtgaacaatgctggtgtgggcctgcccagtggtcccaacgaatggctgaccaaggatgactttgtgaaggtgattaatgtgaacctggtgggactgatcgaagtgacccttcacatgctgcccatggtcaagagagcccggggcagggttgtcaacatgtccagctctggtggtcgtgtggctgtcattggtggtggctactgcgtctccaagtttggcgttgaggccttctctgacagcataaggcgtgagctctactactttggggtgaaagtctgcatcattgagccagggaactatcggacagccattctcggcaaggagaacctggagtcacgcatgcgaaagctttgggagaggctgcctcaggagacccgggacagctacggagaggattatttccgcatctatactgacaagttaaaaaacataatgcaggtggcagagcccagagtcagagatgtcatcaacagcatggagcatgctattgtttcccggagccctcgcatccgctacaaccctggcctggatgccaaactcctctacatccctctggctaagttgcccacccctgtgacagatttcatcctaagccggtaccttccaaggccagcggacagtgtctaaactggggaggatcaatgggtcagtggagcctagaagtgggggaggaaggaaggaccgtggggtcacaaaaggtggtatcggttatcctgggggcattggctgcaaaggaagcttggctcagctgacacccactgctgtcgaatttaccagtaacttctaacagaaggtgaatgcctcttcccaccctctgggaccccacagaaacctgaggtggtctttgcaggttcagcgatctgcagcaatagctccaaggacgtctgtcacccaatcaggatacagctttttctggtcctggaaaagtcatggagaagaaaaccagctcctgtggaatcatgagcccctttcagttatcactgccactgagaaatactgtgggataatcttgcctccaggagaatctaaccaccttcctaatgggtccctcaatatgcataacttcattcacataacccattactgaagtatgcggtagggcagatagggagtgcaagattaaatcagacaaaagtttaaaatattttctttctttttagattcttctatctataggttattgggatccacatgaaataacattcatttatttaatcaccattaatttttcaaatatttattgagtgcctactacctaccgggcactttgtaggtgctgggggaatataaagatgattaaatcatg

SEQ ID NO: 620 - DNA, 2091 bp, Homo sapiens
tccattcggacgtctccatcctcagaacctcctctcttccccaaaaagcaccatgacttgtggatcttactgtggtggccgcgccttcagctgcatctcggcctgcgggccccggcccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaaatcagacctggaggccaatgtggaggccctgatccaggagatcgacttcctgaggcggctgtatgaggaggagatccgcgttctccagtcccacatctcagacacctccgtggttgtcaagctggacaacagccgggacctgaacatggactgcatcattgccgagatcaaggcacagtacgatgacattgtcacccgtagccgggctgaggccgagtcctggtaccgcagcaagtgtgaggagatgaaggccacggtgatcaggcacggggagaccctgcgccgcaccaaggaggagatcaacgagctgaaccgcatgatccagaggctgacggctgaggtggagaatgccaagtgccagaattccaagctggaggctgcggtggctcagtctgagcagcagggtgaggcggccctcagcgatgcccgctgcaagttggccgagctggagggtgccctgcagaaggccaagcaggacatggcctgcctgatcagggagtaccaggaggtgatgaactccaagctgggcctggacatcgagatcgccacctacaggcgcctgctggagggcgaggagcagaggctgtgcgagggcgtcggctcggtgaatgtctgcgtcagcagctcccgcggtggcgttgtctgtggcgatctctgcgcctccactactgcccctgttgtctccaccagagtcagtagcgtccccagcaacagcaacgtggtggtgggcactactaacgcctgcgccccctccgcccgggttggcgtctgcggcggcagctgtaagaggtgctaggaggctgccgcctccgccagcgcctgtcgccgtcactctccacccagccagtacctcgcgccaccagaacgcgccgcccgcgccggcctcccaatagccgccgcccgctgcctgcactctaagcgccctccccaccgctccgctccgggagccatccccggtcgcaggagtccggggagggccgggaggcgccatggtctctctctgtagcctttcctggtagtcaatttgttgtcccgaggattcatctttttcttccgcctgccttctgttttttttgctgtatacattggtcttgcctgagctcttccccaaagcttggaggaacgggggaggcccgggaatgtccctgtctgcacgacctgggactctgcccatgtgcttttgcctgtggaatggagacgcggaccctggatagtggttctatgactctgcgagggacaggcccacgcgtgtggggagaacatctcccttccggggctgccctcaagagcttctgaaaaactaatgactctgctgccttctcctttgtctttgtttcactctgtgtttccaataaactcattgtagcgaatcaa

SEQ ID NO: 621 - DNA, 1291 bp, Homo sapiens
ggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccagggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggtatggctgcaagactagaaaccaggactagaaactgggggagtagggaggcatgcctaggaaaaggagggatgcaaagagaaggggctttgtgaacatggtgcaaggccaggaattttgggagcaaaaaccaagtatccttgtggttcaagcctgttttcttccatcttcaggactcgtgccttctgctgttctcattgtggccaagaaatgtcccagctgagggcctttgtcccattgtccctctgtgaccccttcatctttgataaagcactgacatctccttcctaataaatagaccctgagttctgtaca

SEQ ID NO: 622 - DNA, 636 bp, Homo sapiens
gagcctccggccgcccgccgggtttgtcccgcgatccccgaccatgcccgccgacctcagcggtacttggaccctgctcagcagcgacaacttcgagggctacatgctggccctaggtattgactttgccactcgtaaaatagccaagttgctgaagccacagaaagtgattgagcagaatggggattcttttaccatccacacgaacagcagcctaaggaactactttgtgaaatttaaagttggagaagaatttgatgaagataacagaggcctggacaacagaaaatgcaagagtttggttatctgggacaatgacaggctcacctgtatccagaagggagaaaagaagaacagaggctggacccattggatcgaaggagacaaactccacctggaaatgttctgtgaaggtcaagtgtgcaaacagacattccagagagcctgatccacatccagcagcagagcccacttgtggctgcagctttatgccaaattatattgcagactgaacagacgtttatctatcccatttggcgacgaggactcgtggctggagagagccacacagcgtgtaacctgaagtcatctagattatggggaaactgctcagcttcaataaacctgtccaaatga

SEQ ID NO: 623 - DNA, 2182 bp, Homo sapiens
tgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttggagcttgcggcccccacccaccgcgtggcgtccccaggcacgcctagaattctagcacctcaggatcagtccagcccccatttacaattggggaaactgcggctccgaaagggtcagagggtacccgaggtcaagcagtagagagcggactcgaacttaagctcttgctcttaggctgagacgccttgatgtggccaccggctaccctctagtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttcca

SEQ ID NO: 624 - DNA, 1472 bp, Homo sapiens
ccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaacctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaag

SEQ ID NO: 625 - DNA, 4267 bp, Homo sapiens
tgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctgcctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtgatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccagattttgaagcagtgggaagaatattctgtcttggcatgggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtgatccagagactccatgaaatctatttttttaattcccaagtgtctaaaaagttgaaaacctaaaagattcaagagttaaatgatttttggcatgcacaatttgattttattgccatcaaaagtttcatgacaacttagtcagaacaaaacgtcgatcacctttaatttagcacaggccttccatttatttctaaacttttttttaactcaccatttgactttctgatattgtaaaatgtgtgtgctgtttttttgtgtaattgaagcctctgaaaaaataaatgaggtgggttttgctgtaatgtccctagtacttggctaaagctagtaaaataaatagatcccattcacaattgccacaaagagaataaaatacctaggaatccaaattacaaggaatgtgaaggacctcttcaaggagaactacaaaccactgcttaaggaaataagagaggacacaaacaaatggaaaacattccatgcttatgaataagatgaaacaagatcatgaaaatggctatactccccaaagtaatttatagattcagtgctatccccatcaagctaccattgactttcttcacagaattagaaaaaactacttcaaatttcatatggaaccaaaaaagagctcacataaccaagacaatcctaagcaaaaagaacaaagctgtaggcatcacgctacctgacttcaaactatactacaaggctacagtaaccaaaatagcatggtactggtgccaaaacagatatatagaccaatggaacagaacagaggcctcagaaataactccacacatctacaaccatctgctgtttgacatacctgagaaaaacaagaaatggggaaaggattccctatttaataaatggtgttgggaaaactggctagccatatgcagaaaactgaaactggatcccttccttacaccttatacaaaaattaactcaagatggattaaagacttaagtgtaagacctaaaaccataaaaaccctagaggaaaacctaggcaataccattcaggacataggcatggacgaatacttcatgactaaaacaccaaaagtaatggcaataaaagccaagattgacaaatgggatctaattaaactaaagagcttctgcacagcaaaagaaactatcatcagagtgaacaggaaccgacagaatgggagaaaatttttgcaatctatccatctgacaaagggccaatatccagaatctacaaagaacttaaacaaatttacaagaaaaaaaaccccatcaaaaagtgtgcaaagaatatgaacagacacttctcaagagaagacatttagtcagccaaaaaacatatgaaaaaaagctcatcactggtcattcagagaaatgcaaatcaaaactacagtgagataccatgtcacaccaattagaatggtgatcattaaaaagacaggaaacaacagatgctggagaggatgtggagaaataggatgcttttacactgttggtgggagtgtaaattagttcaaccactgcggaagacagtgtggcgattcctcaaggatctagaaccagaaataccatttgacccagcaatcccattactgggtatatacccaaaggactataaatcatgctgctatagagacacatgcacacgtatatttattgtggcactattcacaatagcaaagacttggagccaacccaaatgcccatcaatgatagactgaataaagaaaatgtggcacatacaccatggaatactatgcagccataaaaaaggatgagttcatgtcctttgcagggacatggatgaagctggaaaccatcattctcagcaaactaacacaagaacagaaaaccaaacaccgcatgttctcactcataagtgggagttgaacaatgagaatacatggatacagggcagggaacatcacacaccagggcctgtcagggcgtggggggctaggggagggataacattagaaattcctaatgtagatgacgggttgatgagtgcagcaaaccaccatggcacgtgtatacctatgtaaccaacctgtacgttctgtacatgtatcccagaacttaaagtataataaaaattaaaaaaaataaagatctga

SEQ ID NO: 626 - DNA, 1637 bp, Homo sapiens
gggaagtgaatcaggcgccgggtagtgggttgctgggctgggcttgctgaggtagaggcagcgccaagaagaggcctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcattccatcacaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggcacttgctgctggaggagtagggtccattgttcgtgtcttgactgcaagaaaaactgtgtagtctggcaggaagtggattatctgcctcgggagtgggaattgctggtacaaagaccaaaacaaccaaatgccaccgctgccctgtgggtagcatctgtttctctcagctttgccttcttgctttttcatatctgtaaagaaaaaaattacatatcagttgtcctttaatgaaaattgggataatatagaagaaattgtgttaaaatagaagtgtttcatcctttcaaaaccatttcagtgatgtttataccaatctgtatatagtataatttacattcaagtttaattgtgcaacttttaacccctgttggctggttttttgttctgttttgttttgtattatttttaactaatactgagagatttggtcagaatttgaggccagtttcctagctcattgctagtcaggaaatgatatttataaaaaatatgagagactggcagctattaacattgcaaaactggaccatatttcccttatttaataagcaaaatatgtttttggaataagtggtgggtgaataccactgctaagttatagctttgtttttgcttgcctcctgattatctgtactgtgggtttaagtatgctactttctctcagcatccaataatcatggcccctcaatttatttgtggtcacccagggttcagagcaagaagtcttgctttatacaaatgtatccataaaatatcagagcttgttgggcatgaacatcaaacttttgttccactaatatggctctgtttggaaaaaactgcaaatcagaaagaatgatttgcagaaagaaagaaaaactatggtgtaatttaaactctgggcagcctctgaatgaaatgctactttctttagaaatataatagctgccttagacattatgaggtatacaactagtatttaagataccatttaatatgccccgtaaatgtcttcagtgttcttcagggtagttgggatctcaaaagatttggttcagatccaaacaaatacacattctgtgttttagctcagtgttttctaaaaaaagaaactgccacacagcaaaaaattgtttactttgttggacaaaccaaa

SEQ ID NO: 627 - DNA, 3525 bp, Homo sapiens
aatctctactcggcccgcaccagcagcgctggcgtcagggcgcggtgggggcaagacgggtgactggcagcagggcggtgccgggccgagaagggcgcctcacctggcgcctcctgccttcctttccacctcaggttgcagagagccgccagggcaggtggaagggccacgccccgctcccgtgagggtcaccgagagacgttgggggtggggcagggaccccaaccctagaccagtcctgtagggcacaatgtctgaacaagagcgtatacaggaatgtctgcggaaggaaataaggtcacttctcatttccaccaaagatggtttgagcccacaggagttggagaaggagtaccttttgatggttggcaaccatctaccactccgaatccttgggtatcggtccactatggagctggtattggacatgcctgatgttgttcgtgtctgccccggtgcaggtggtactgtaatactgaaagccattccagatgaatctaccaaaggaatagcaagcttagttgcaaaacagaggagcagccataagcttcgaaactcaatgcataagggaagacctagtatttattctggaccgagatctcatcggcgagtaccttaccgaggaagggttgcccctattcttccagctgttgtgaagagtgagttgaaggacctgttggcgttatctcctgttcttctttctgattttgaaaaggcatttgccaaaagatttggacgatcattccaatacatgcaatatggatttctctctatgtttgaagtgcttaatgcggcttcagatgtcatttctgtagagcagaccagagcaggttctttgttgatgctaaagaagagtgtaacagaggaaaagccgagaggatgtccagcaggtaaaatttttacccagccatttagaatgaaacaagggtcatactccacaggctttccggtagcaaagccatgcttttcacaacccacttcaaacatggaaccaccgaagcaaataatgagcatggaaaagacttccaagttaaatgtagtggagacttcaagactgaatcacactgaaaaattaaaccagctggagaacacattcaaatcagttattgcacagattggacctggaggaactatcagttcagaactaaaacataagataaaatttgttgtatctaagttcccagagggtttgtttatttctaaactgcttggagagtatgaggtaatttttaaagagcaactatcaccaaaaaaattaggcttcttaaatgtgacagaacttgttggagctcttagtgacattctccatgttgagttcaggaaaggacaccaagacttactagtgtttgatgcggataagaagcctctaccacctgttcagtcagataagaaaatagaagccaaagcttgtgtctccagtccacctagaaattcattgtctactgctgctgtcaaagagactgtatggaattgcccttcaaaaaaacaaaaagagccacaacagaagatttgcaagaagcctaatctggtggtaaagcctttacagctgcaagtagaaacaaacaaatcagagctcaacttggcaatggcaaatcatgacatcccgccagacgctgtgccgaacaagaaattatgcagactcccaccattagacaccagttccctcataggggtctttgtggagtatatcatctctcctagtcaattctacatccggatctatagcagggattcgtcagagttactcgaagacatgatgattgaaatgcggcgctgttattctaatcagctggtttctgatcgatatgtcatgccagaatgttttattcagccgggacatctctgttgtgtaaggatttctgaggataagtggtggtatcgggtcattatccatcgagtccttgagaaacaggaagttgaagtgttctacccagactttggaaatattggaattgttcagaagtcctccctgaggttcctcaagtgctgctacacaaagcttccagctcaggctatcccttgttctttggcttgggtgagaccagtagaggaacactggacatcgaaagctattttgcagttccagaagttgtgcggtttgaagccattagtgggggtagtggatgaatatgtagatggaatccttaacatttttttgtgtgacacatcctcaaacgaagatgtctatttccatcatgtcttgagaacagagggccatgctattgtatgccgagaaaatatctcttctaagggtttcagtgagctcaaccctttagctttatacacgacatccagtggagggccagaggacattgtcttgacagaactgggttatccttcccagcagcactattttaatgaagaccgaaagataagtccacagtcaaaagagagtgagttacgtatcttggatgagatccccactggaatgccatgcctggagtcagtgaccataggtgatgatatttgggatgagaactggttacctctacaggctaagatgggaaaaggaggtgatgctgcctcccatctatttactgcaagccttggtggaaagaatcagtattcatcatgtaaagaaatgccacagaaggactggtgtttttctacccctaaagatacatgggatgattcttggcagccttcaggccttgtaaatggaacgaaagtagaagttcataagccagaagtactgggtgctcaggaaaaaaatactggcacaaacaggactcaaaagcaactagacataaatggttcttcagattcttccacactgcccaaattggaagaattctgtacctctcttacccagtcagagcagtcagcagacgggagccagtctgaacccaacaacagtcagactcagccaaagcaaattcagctttccacagcagcaccctgttcaacaactgcagtggatgattccgcagaaaagccctctggttctgtggaaagctcaccagagatcctaaagaatgaagatttttctagcagccgtgctattacattgtacaaagacaagcgtcaagaatctgtagaccagctgtctttgattttgtcttatgagtgccagatttctcagaagctctacattcctcgaagtacagccactgctgccttaggtgctgccgcacggttagctacatccaggagcctcctacactggtaccccagtgtgaaaaggatggaagcatgagggagggagggaggagggagaaaaacagaatccagccgcttaggctttgatgaactcccaggccaaaatgaggagttattgaagcaaaatagtatcttgatcattgatacttttgtctttctgtgactatatgttagctttattatgctaacagtctactttgatgtgtaagtaagtattgatatttactgttaatcttgatttttcttgattttattctgtgtcattttgttcacctttgtttttaatgtagtttaaaggaatttgtttttttgtgtttgtttttcttgtacattatcatgactgataaatgaaaattgaaaaactaa

SEQ ID NO: 628 - DNA, 5448 bp, Homo sapiens
ttcaaattctcccaagctggaggtagtggagcaaacaagatcagcaacaatgagggagcagctgcaccactttgtgttactctctgatggccagcacagggctgcaagtagtggctgcaaaaaccagacaaatagatggaaatccaggaactagaggaaattcaggcctgccaggggctctgggaagtgtttgttactctctcagaaagagccagggattatctgcacaaaactggaaggtttattgtgattggcgggattgtctcccctgtccacgactcctatggaaaacagggcctcgtgtcaagccggcaccgtctcatcatgtgtcagctggccgtccagaattctgattggatcagggtggacccttgggagtgctaccaggacacctggcagacgacctgcagcgtgttggaacaccaccgggacctcatgaagagggtgactggctgcatcctctccaatgtcaacacaccttccatgacacctgtgatcggacagccacaaaacgagaccccccagcccatttaccagaacagcaacgtggccaccaagcccactgcagccaagatcttggggaaggtgggagaaagcctcagccggatctgctgtgtccgcccgccggtggagcgtttcacctttgtagatgagaatgccaatctgggcacggtgatgcggtatgaagagattgagctacggatcctgctgctgtgtggtagtgacctgctggagtccttctgcatcccagggctctggaacgaggcagatatggaggtgattgttggtgactttgggattgtggtggtgccccgggatgcagccgacacagaccgaatcatgaatcactcctcaatactccgcaaatacaaaaacaacatcatggtggtgaaggatgacatcaaccatcccatgtctgttgtcagctcaaccaagagcaggctggccctgcagcatggggacggccatgttgtggattacctgtcccagccggtcatcgactacatcctcaaaagccagctgtacatcaatgcctccggctagcagcccctcgtcctccggcaacacaatggcccctccatctttgtcagccccctgtttctctcctgcctctctgtttctccatctcctcgtcttgactgttttccctacttgctgacttaaccccccatagtgtgggggacctgcagagaaccatggcattccctattccacagtcatctttggacagactttcctctagtctccgggttgggggtgggtgagggaatggggtgggagtcgggggaagtgcagtccttggagatgtactggtgtccgtctcccagcatgctctagagaggcggctctggtgcccatcctcccagcacgctctggggaggcggctctggtgcccatcctcccagcatgctctagagaggcggctctggtgcccctcctcccagcatgctctggggaggcggctctggctcttgccttcccagcatgccctttactacaaagggctatttttcttttctttcttttgtttatttatttttctttgttcactccctgtagaacttggatgaaatcagtgtccatggttctttatgtttgtagtcttgatgtgctcctgtggtattacttcccctctgataggacattgtagccagcctcagcactcagtgagttcatcagggccacacccagtagagaaggccaagcaacctccacttcttcagcaccacacacacgcacacacacacacacgcacacatgcgtgtgcacccgcgcacgcacatacacacacacatatagcagtagcagcagcagcagcagcagcagcaacctttgatcaggagtgagattttcgggttctgaaacctgggacacgagtctgtgaatagtcggttttctcagaataatttgaatctgttttcttagtttcaaatgaccatttccctgatgctctgagcttatgatcacacagagccagtccatcctcatttcctggtggcatctgttcatttacctttgtggactgtagctgatggcacagtgcgggttccctaccagccaggggtttccaagggacctttggaggccatgcttagacacattcctgtacctgagaacaaccacataggcaggaccagatccacatcgtgcagtcgtgtcataaaaaaacaaaacaaaacaaaaaaacactaggagtccactcaaccctggaggtctttgctaattggaattatgtattgtctgttgggctgggaaatgtctctttcatattgtaagtccaggatgaactaggagaaagcaatttgttgccctgatgataactgatgattttcaccctctctagctgaggtaactcagacagtgcatgaggtcagtttcttcttgagaagcagtgccttggtcttgtttctgtggttggttctagcccctgcagagcctgggagctgcaggaactgtctgagaaaatctccctaataggggagtgggttcccagaagggagatctgggaggggtcaggagccactaagttgcttcactccttttttctctaattttctaccttcctctctgttcctgcagacagttttgccagctttgcttctggttactagggtctcatgcgtgtcctgcttggagagccataaggaaattgctgtcttgtgctttgtgtctctcatccagtctctggctcttgggattctggtctttgagaaatagtccctgagtattaggatacttttatcaaaatctagtaccagctacggccagaaagggccaggtgggacctgaaagcaaagacaatgttctttaccacacgtttcacatctgcaacatccttcaattgcgggaaaaggaacttgatttaacagaagaacatggtagagcagcatccagaaagtctgttattcctcttggattttttgaaataatcttcagaggaaggaaggaaaatcctattttggggtatcagtgtttgactagggatcatgaaataataaactgaaaaaaactttagagttcagttgatccaacactttcctttaaaagttgagggagcagaggcccatgggattaaatggctggtccaggtcagccagcaggtgtagggcctgacaagaacatattgtttccctgacccctaggccgtcacaccacaccctccatttcctcatgttgctgaccaggtgcccatatgatttctacacttcccaagccttaccctggcatctttcttttaaattatatctgtcccaggtgctctccacacataggatggtaatgccagtcccaggggagggtgtgatagtaaggaaggccactgttaggtttcctttagaaataaagagatctcagcagcttggaagaaatcccagaagcggactccatcaatccaagaaagagttgctttgtggaaggtgaaggaagacccacagagtgctcaggatgatgctattgctggagagcgaaagatggaacagccttgtccaggcagaacagtcataagccaggaaatgaaacaaaggaaaacaggtgcctgaatttcctggggaaacatggcttgtttaaggacttggagttatggatggaatttatgggacccacgtgagcagacctgaggaaggctcgatttcttttgtttcttggtccactctgtcactctgctctggtcaagccccatttggtctacagcccatgagaaggaatgaggctggttctgcactctcagcatgcagtccgaaagcatgtgggagtggggagggaaagtgagatgaattaagacaaagaacaggtgccatagaagtagatttctaggaatgaagtggggcagatcttatctttgtggattacaggcactgtactaaaaacaggtttcctatttaatataaaaagaaagtgaatcttcttttggatagaatcatccattcccatcgccgcaccccctaccccccaaacacacacacacacacacacacacacacacacacacacacacacacacacgccctactcttcatttgctaggggaaggtcacagcacaactaaatccaggacaggacattgtgaccatgacccagccacagtcaataccagaaagatgattcagagtctgaagtggtgccccaggtgccaacaggataacctctaccccccgactttgtctctggggtcctgttccttcctgcaaagcccaatccaagactggcatggctcagaggttgtgagaaaggcatggactggaacaatcatgtccagaggggtctggagctttgtttcctgttcaccagcaaaaaatgtctctcccatttttctgaaagtggctgatgtaagaacaggcagaaggaaaaccctttttgtcaataactctgtccttaaggaatggtcctctgggagggctgtgctgctagtgggtacctcagtcacacacccccaaccccaggcagcctctagagccttcttgctttcattttccttgaatgtacataggaacaagggggaaagtctcttactgaagtgcctgaaacccaaagctagagcttctagagacgccgttcttcctgtctcagcttggccagcctttcaacaatgttctctagtttcaagctccagcttctcagaaagaattaaagaacttgctgttcaaattaagtagaaagtgagactcaataataactgaactacagcaaaaggcagagaattacagggagaaaaaacttgtacttaccagcccaattctactctcctcaaactgacacacacacacacacacacacacacacacacacacacacactcttttaggggactaagagagagaagcatgttattacattttactcatccaaacagtaatgcaaaaataaaacggtagaatatgaaaagctcaggatctctcccaaggctacctactgcaggagggccaacaggtgagatgggaagaatggaaacagggaccgattttgtagctcatacaattaggacaccttaggaatagcattgtagtaatggtgatgaatatgctctgccaaattcatccagtctgcaccatcttatagctgcccagcacactcgactgttcatgtggtctctttgtagtgtgagtttggagtgtcctattagcctgttctggttaggaatgagttaacggctctttccctcaaccttagtctagtcccagggctgaggattcagctggatccacatggtcttgagggttggcatgaggagggggaagcttttttgaatcgctttttgatcacataatctgccattttaagagtaagatttgctttatggaaatcaattcattaataaaaaatgatattcaagttgcaataccatttcacagtgaaatattttgagtacaattttgttgctagaatagtcatgggcaagagttttatgcaaaatgtttcaattatgttaataaataagacaatgctacaaga

SEQ ID NO: 629 - DNA, 1265 bp, Homo sapiens
gctgcgggcctccgacggcgggaggacagcgctgcgaggaggcgcccgggacagtcatggagcgccgcctgggagtgagggcctgggtgaaggagaaccggggctccttccagcccccggtctgcaacaagctcatgcaccaggagcagctcaaagtcatgttcatcggaggccccaacaccaggaaggactatcacatcgaagagggtgaagaggtattttaccagctggagggagacatggttctccgagtcctggagcaagggaaacaccgggatgtggtcattcggcagggagagatattcctcctgcctgccagggtgccccactcaccacagaggtttgccaacaccgtggggctggtggttgagcgaaggcggctggagaccgagctagatgggctcaggtactatgtgggcgacaccatggacgttctgtttgagaagtggttctactgcaaggacctcggcacgcagttggcccccatcatccaggagttcttcagctctgagcagtacagaacaggaaagcccatccctgaccagctgctcaaggagccaccattccctctgagcacacgatccatcatggagcccatgtccctggatgcctggctggacagccaccacagggagctgcaggcaggcacaccactcagcctgtttggggacacctatgagacccaggtgatcgcctatgggcaaggcagcagcgaaggcctgagacagaatgtggacgtgtggctgtggcagctggagggctcctcggtggtgacaatggggggacggcgcctgagcctggcccctgatgacagcctcctggtgctagctgggacctcgtatgcctgggagcgaacacaaggctctgtggccctgtctgtgacccaggaccctgcctgcaagaagcccctggggtgaccctcttgccatggcctgaagcagccacaggtgtgccaagcaccctcgagtgccatccctgccaaacaactctcccagcccccactacctctctgtgtactgccgctgtgtcccccacagacctgcacattgttgtcacccaccctcctgcccttctcagcccagatgccatgcccctgggcgggcagcagctccccatcttctctggcagactcagcccactgccttgccagtcttgccaggtggtctacccccggccccgctcctgcccattcctctgtccctgcagactcagtgcagcacttccacaccaagaaggccctcaataaaggcttcctgaggaacgca

SEQ ID NO: 630 - DNA, 6866 bp, Homo sapiens
cggagggagtaggagagcccggggcttcggcaggcagagcaggcctctcccctccgtcctcgtcgtcctcgtcctcctcctcctcctcctcctccgtggtggtagtggtgggacttcccccggctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtggtaagaggcgcacttgaaatctctcaaacgttgttgggaataattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcctcaatgacttagatacacagtataactgatgctcttctggaataccacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaagagtaggaatcagcgatacaaccactttggaagtttatagtataattgaaattattagaagaattcagcaggttacagacatacttaaactgggattaaaacctcatagtcatttttcttaattgcccttaatattttgacatatagggatacataaatttaaagaatattttttctcagttttttcagatattgccatactgaacctcattctaaactggtgctgtggatagtctttccctctcccctcctgttttagtttaaggaaaggtttccttcatggaaaagcacttttaattttgagaatttcacatttaaaataagccaaaagcctgatgttcacattgtgcttttaaactccgtaacagctgaatacaacataacatagtctcccttgaaattccctccctttttcagtagaggataaatagggtgactccagctgttggaatgagaatggggatacccccaaaataagattctggtgaagaaaaagtcttgtactaagttcccctttaggtgtagccaagtctataatataattatgatcatgaatagactccagaatccacaaagagaagagggcttggatgtcaaaaattcttccattgtggggtaggtggtcggggatgggagaaagggaaaagtcagggaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctacggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaaaaaatccaattttgtcagtattttcttagtctgaaaaaaacagcagtagtaatctggtgaatgttattattaggagtgttctgcctctacagtggcatattccatgacattaatagaaaacccttctttcccacccctccccatcttgacattttcttttttaggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgtacttacaaaccaagctgtagagatcaagaaaagaacttaagtgttgatctcaagatttctaaattgtcaagatttacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttcaggtctctgatatttattttcacttgtttactaattatttacaaaacaccctttgttgacttttattttataaatgtgtaatgtattaaacgtctttaaatttttgttcaactgaaactacattaactttgatttgctttactgggatttttttttaaagacactttttccatgtcagtgcgcagcacttaaccagtcgtttgtattccctttctttcaatccaataaacagaatgaatacct

SEQ ID NO: 631 - DNA, 5326 bp, Homo sapiens
gcgtggtcgtcgccaccgcagccgcccgagaggagctgggggaggacggtggcccgcgaggctcgtcgcagacaacgcggcggcgatgtccgcgagccaggcgagtgccgcggcggcagcggcggggccttgcgcgcggcagggcggcctgggcttcggcctccctccggttccctggaagcgggcccgcgaccagcgcgggagcagcagcagaggcggaggctccagcgcgtctctctcctccccctcagcctgagccgggggaagccaggcggcccgggtgtctggagggggggggtccgctgcccgagaatgggaattctcttcactagaatatggagactgttcaatcaccaggagcacaaagttatcattgttgggctggataatgcagggaaaactaccattctttaccaattttctatgaatgaagttgtacatacatctcctacaataggaagtaatgtagaagagatagtgattaataatacacgtttcctaatgtgggatattggtggccaagaatctcttcgttcttcctggaacacttactatactaacacagagtttgtaatagttgttgtggacagtacagacagagagaggatttctgtaactagagaagaactctataaaatgttagcgcatgaggacctaagaaaagctggattgctgatttttgctaataaacaagatgttaaagaatgcatgactgtagcagaaatctcccagtttttgaagctaacttctattaaagatcaccagtggcatatccaggcatgctgtgctctaactggcgagggattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccagtttgctttctcattagttttttccaaagtaagttattgaagctgtgattgacatttttctcataatgaatcctctcaggacattgtgtagcctatggtaagtacaaagggagaggaagacattttgaattttaagagctttattatcagtttaaccctccctagttgaatgttattttcttcttgttccattaagtcagaatacaaatcagcacagatattcgaatgtttccaatattttaaaatgtaatgttacttatgaaaagtattttgcttaaggttgtgtgtgtattgtgtatatacctcaagttcaagttaatggcattgatttatgttccagacaaaaataacacaaataataatatccttcgttataaccacaatgagataagtattggcattagtgttcagtgccattttatactttctctctgtgttctctgtattgtactaaccaacctcccaaatcgctgagctgcttgtttaaaaaaaaaaaaaaggaaaaggaaaaagcatgacattgtgtatcgattttttgttgttgaccaaaatcacacacatggaaacatgtaattcaacagagtgggaaagctagcagattcttggcttagtattactaataggcaggattgtacaatgagcaactatcagattattcctttcagtggttcttatggcatctaaattactgaataaattattaatccattaatcagtgaatcaaattatgattacaattatcaaatgaatgctcagcattaattgaaaactgttttgtgaaacatgtctacccagaaaagtagcattctataaatactattaaacaacttagctatattatttttaagtattaaattatatgtcaagcagttaaagtgaatttcagagtaaaagtaaggcatgtttctgagcaacattgataatttcttaatttgcaaatttcttcttattttggtacttggaatatagtgtgagattttttatttctaaattttgttgtatcttctattacataaatgcattgacaattataaaatgcaagtgttttttgaatgattttaagaatttggcttaaaaattgattgatacaacgtattatttgtactaagaagtaacttgacccaaaacaccttttatgtttgcttagggtatattttttcagtgtctgaaagtcaaaggtattcctgtcacaactgtaaacaaacttatcctaaatgtgttaaaacatattcttgggtactctatttatgtatctttcatgccttgaaaatctgaaggttaatccaaactcacatgttttagcatatttgagaaaaaaaaactaccttcaatatcagccttttaaatttcatgaagattttggtgaggaataatagtatatagtttaagtattgacaaaactttgaaagtttctttctttaaaatgggaaatactcaatatctaaatccaggtcaggcatgggatatcagtatttaacattggatgttttatgttttatatttataatgttcaaaatgcaagcataacatttaatatttgtccacatggttttacaaaagtaaatcttaaattactaagcttttcccatatgttctcgtactttctcaaatccctataaagaattacttgttatctattaaaaatctcctttacccaaatctgtattatggtttcgccagacaaatattatgtgatgtagcccagaaaatccacaccttttgtcctttttatgttttaatttgaataatcatgtgcttagtcccttggattactgccacatcagtttaacacgatatcagcacattcccttgtcatcatcaaggtgttggctcagatttattcttaattggatgtttaaagcatgtactaccttgttacagttggtttagtgtagtggattattgacatgacatcatgagaagatgtgtaattttataccacatttataaaacatgattttgttttctacccttcaaggtaaacattaaaaataaggtggtacttgtgtacttgtacataaaaccaaaattatagttgggaaaaaaataaatttatatatgaaaatgtcaaaatcattttaaaagtattattttcaaataaaatggagaagctggtgaaaagtcatattggcaatttttatgtagtttaagtggaattaagcagagggagatgcttttgggtttttaatatgccacttctgagtgaaaacatctcgtggagtcattgtgttcagctctgagaagaacaaagattcatagttctgtacatgtggctggatttaaatatcctgtttttgatactaattttgaaagtcatgtaacttcttttgatatctgggcaaaagtaaccatatgctataagcatttgaatatgtttaattttatcataatagcatctgtaaaagtacatcttacacattatatagagggttcttgtttgaaattttcagttctctttatcttcccagtacctcttggtcctcataatgggcaaaggatacaacgaaggcaggttgtataggggttatagtggggaagtggataggggattcattttcttatgtgacattttgccttaagaatataaaagtgctttagcactgatggctggcatttttaatataggcagtgaaagtgactttagaagcatgggatgaaatagagggaagaagagtttttattttctggcctttaaaaagtgcctagtaggtcatttgagacccagagaaatgcacagagcttgagcaaaggcatgaagtccctgacattgttttcctttttgtctcagcatatagtattaagatgcctagaaataggactctattgttccctcttgtataggcactttacatttcttgtcactacagcaaccacatacagtacagacaacctccaaacctgtttatattagtgtaaatagaaaatctatagacaactttctagttttctctggaggcatttttgggaatgtacgtgtaataggctctgctttgtatacaggagataataccacatcatcggttatctccaaactccagtcttctctcaactgcccagttgtatgttgtcatcaatcactttttcaaggctgggtagagacaagtttctcctcgtaactttgacctctcccactctccaaatgtaatctggacctcattgctttcaaggtcagcttccccatagctcaggtatcctttgctctcctgtatcttcatttactattagtgaagagatctctgtcctggaggttattctaaactttctttgtaactattgttatagacaatggtttccaaaccagtggtttctatgtagcttttctagttccttgctatcttctcaccactggcttgaggtagtgatttggactttgctcattagagagcattatcagagatgtggagtccatcagaagaccagcttgcagtgtgtatagcatatagatgccaatattagaattctttaaattatatttaacattttcatgcttcttaatttaacttcacatgttgggaagtagattcagaaagataggagaaatacccagactctaccacttccgtgagctactagttaggcatgggcaggattaagttttatgtgtattatcttcccactaccaagaatggttatgtttcacagaataccagttcagtttgatttggaaaaagatgccaaaccaaatttatatgtagtctataatctaagggcattcttgaaactattgcccacatcccattttttttttcatgtttacttacaaaacagagataaacattagatgtctaaaggagttagtaatgaaaagcctatccttaaaaaataaacctgttgaaatgggctttaaagacatcgaaataatcacttgtcatgcattgactgtaaatgcagatagagaaatatgtctttgaagctccacttacacaaaaataaaacttgtatatcatgctccctcaaagaatgtgcgatagattattttaagaccatgataatagagtaaaaaggaaagaaagccagaaattacaattttggatgctaaaaagtaactttctagttaaccctaaagtcctgtcagattgtgaagaaatgttccaggatacacttggattagttatgcagtatttcttatcaatgtctagcccttgtgtattgttctgaaaactaaagtttaaatctttatgctgttgcttgctagatatcctgttctttggtagaaaattcccatagtctgtactcaagaagtgcctaaaaatggatttgtgttgattttaagcccatctaataaattatatgtattttcta

SEQ ID NO: 632 - DNA, 1775 bp, Homo sapiens
gcctttttcttcccccagtactgaaattaagcagcatccaacacaggcctactcttacgacatgtgactttactgttttccgtttttgttgaaagagtcattaacagttaggagttgatggcagtttcaataacaggtcattgccgagaaaaggatagcactataatatgcagaaatctacaaattctgatacttccgtggaaacactgaattctacccgccaaggcacaggagctgtgcaaatgagaatcaaaaatgccaacagccaccatgacaggctcagccaaagtaaatccatgatcctcaccgatgtcgggaaggtcactgaacctatatccagacacagaaggaatcattcacagcatatcttgaaagatgtcattcctccattggaacaactgatggttgaaaaagaaggttatctgcaaaaagctaaaattgcagatggaggaaagaaactaaggaaaaactggtctacttcctggattgttctttctagtcgaagaattgaattttacaaagaatccaagcaacaggctctgtccaatatgaaaactgggcacaaaccagaaagtgtggatttgtgtggagcacacattgaatgggccaaggaaaaatcgagcagaaagaatgtctttcagatcacaacagtatcaggaaatgagttccttctacagtcagatattgacttcatcatattggattggttccacgctatcaaaaatgcaattgacagattgccaaaggattcaagttgtccatcaagaaacctggaattattcaaaatccaaagatcctctagcactgaattgctaagtcactacgacagtgatataaaagaacagaaaccagagcacagaaaatctttaatgttcagactgcatcacagtgcttccgatacaagcgacaaaaatcgagttaaaagcagattaaagaagtttattacccgaagaccttccctgaaaactctgcaagaaaaaggacttattaaagatcaaatttttggctctcatctgcacaaagtgtgtgaacgtgaaaattccacagttccgtggtttgtaaagcaatgcattgaagctgttgagaaaagaggtctagatgttgatggaatatatcgagttagtggcaatctggcaacaatacagaagttaagatttattgtcaaccaagaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaaaacttaatgatgattttgtgtttaagttccaaacatttgaataaaataattgacaata

SEQ ID NO: 633 - DNA, 1505 bp, Homo sapiens
tcacccaagcgactgggagccgcgtcctgctctgggactgagccgttggagctgccccgctgaccgcactaggctgaccgcaaccggctgaccacacacagtcctcactcccctggccctggtgggcggcaggcaccatggcgcagacagtgccgccctgcgagctgccctgcaaagagtacgacgtggcccgtaacacgggcgcctacacgtcctccggcctggccaccgccagcttccgcacctccaagtacctgctggaggagtggttccagaactgctatgctcgctaccaccaggccttcgccgaccgcgaccagtcggagcggcagcggcacgagagccagcagctggccacagagacccaggcgctggcgcagcgcacgcagcaagactccacgcgcacagtgggcgagcgactgcaggacacgcacagctggaagtcggagctgcagcgtgagatggaggcgctggctgcggagaccaacttgctcctggcccagaagcaacggctggagcgcgccctggacgccacagaggtgcccttctccatcaccactgacaacctgcagtgccgtgagcgccgcgagcaccccaacctcgtgcgcgaccatgtggaaacggagctgctgaaggaagccgagctcatccggaacattcaggagctgctgaagagaaccatcatgcaagcagtgagccagatccgactgaaccgggagcacaaggagacctgcgagatggactggtcagacaagatggaggcctacaacatcgacgagacctgcgggcgccaccacagccagagcaccgaggtgcaggctcatccgtactccaccaccttccaagagagcgcctccaccccggagacccgggccaagttcacgcaggacaatctgtgccgtgcccagcgcgagcgcctggcctcggccaacctgcgggtgctggtggactgcatccttcgcgacacctccgaggacctgcggctccagtgcgacgccgtgaacctggccttcgggcgccgctgtgaggagctggaggacgcgcggtacaagctgcatcaccacctgcacaagacactgcgggaaatcacagatcaggaacacaacgtggcggcactgaagcaggccatcaaggacaaagaggcacctctgcacgtagcccagacccggctgtacctgcgctcgcaccggcccaacatggagctgtgccgtgacgcagcccagttcaggctgttgagtgaggtggaggagctgaacatgtccctcacagcactgcgagagaagcttctagaagcggagcagtccctgcgcaacctcgaggacatccacatgagcctggagaaggacattgccgccatgaccaacagtctcttcatcgaccgccagaagtgcatggcccatcgtactcgctaccccaccatcctgcagctggctggctaccagtgagcagcggcacggtgcttccccccagtcccccaaataaacagcgcgttagctttctgcaca

SEQ ID NO: 634 - DNA, 2336 bp, Homo sapiens
gagctacaacagctgagacagaaaagaggtaaggaagtgttgggggctgggacaaccagctccccaacaactcctaggtgtttaaagaaggaggcaggaagacttgtgaagatgggaactatacaagaggcaggaaaaaagacagatgttgggtggagcaactgctacagaggtaaatatgattaactttacattccatctttcgtctgctcccaaacttaacagcaggtaatctgcttctagcaagtggtgaaggtaagagaagcatctgtataggaggcaagagatctgagtccttttgaaggcctatcctctgctctgtatctcaattactgttcttcatttcaattattcttacctactattcagttcccttgatcttttcttcttgggggctgtcttagggtcagggagattgcagaagcaccagaactaggagcagccctgagacatggggagttggagctgaaggaggaatggcaggatgaagaattccctagattgcttcctgaggaggctggcacttctgaagatcctgaagaccctaaaggagattcacaggcagctgcaggtacccccagcactttagccctgtgtggccagcgccccatgcgcaagcgtctttctgccccagagttgcggctgagtctgactaaggggcctggaaatgatggagcttcacccacccagtctgcaccttcctctcctgatggcagttctgacctggagatagacgaattggagacaccttcagactcggagcagctggacagtggacatgaatttgaatgggaagatgaactaccccgggcagagggtctgggcaccagtgagacagctgaaaggctgggccgaggttgtatgtgggatgtgactggagaagatggacatcactggagggtgttccgaatgggaccacgggagcagcgcgtagacatgactgtcattgagccctataagaaagtcctgtctcatggaggttaccacggtgatggcctcaatgctgtcatcctttttgcttcctgttatctacccagaagcagcatccccaactacacctatgtcatggaacacttgtttaggtatatggtgggaactctggagctgctagtagctgaaaattacctgcttgttcatttgagtggaggcacaagcagggcccaagttccacctctaagctggatacgtcagtgttaccgtaccctggatcggcggctacggaaaaacctgcgagccctggtggttgtccatgctacatggtatgtgaaagcatttctggcactgcttcggcccttcatcagttccaaattcacacgaaaaatccgttttctggacagcctgggggagctggcccaactcatatccctggatcaagtccacatccctgaagctgtcagacagctggaccgggatctccatggctcaggagggacatagcacaggactggataaaaggccttagaaccagttagtgatctgcctacacctgaatccctgaaacatctgaactgttttgtaaatcatcttatccccaacctcagtaccaccggatcttcacttctcagtgggattttgtcctttgcatgaccctactttcagcagggctttgaggctgggaaactgatctgctgggtgactttcattccagttgctgggacggaaggctgaatgtagggtcattttgtatgggatatgcagagctctgggtttttttgttttttgttttttgagacggagtctcgctctgtcgccaggctggagtgcagtggtgcgatctcggctcactgcaacctccgcctcccggttcaagccattcttctgcctcagcctcagcgagtagctgagactaccggcgcacgccaccacgcccagctaattgttttgtatttttagtagagacggggtttcaccatgttggccaggatggtctcgatctcttgacctcgtgatctgcccgcctcggcctcccaaagtgccgagattacaggtgtgagccaccgcgctcggccagagctctgggttttaatcctactttagctgtagaaccttgggcaaataacttcatctttttgggtcctaattttcctcctgtctaactggagggactgtgatccttccaccttggatggaagaggcttacctgacagccagcctgcctgctgggagccaggagagtcagctcattaaatcttgaagaaccgctgtatgccctttttccttctaagtcatgtctgctgcctgtgagcctgggaaggagtgctttcaaaacctgtatttttgccctctttagtaaatttagaactgtagaggctaataaactgcgatgagacatttaa

SEQ ID NO: 635 - DNA, 2626 bp, Homo sapiens
cctcgatcccctcgccgcggtcccatggaggaggaggcgagccgcagcgccgcggcgacgaacccagggagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaacaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 636 - DNA, 1914 bp, Homo sapiens
agaccccctggcccgtgcgcttcgcaggccagagcccctctctcacccccagcctaggagctccaagctcctcaggccaagggacggattccctggcgtttagccccatctcttctggctgcctgcatacgttgcctgacttataattcttctccacccgcctctccctccggtctctttcggctccctttcttacaattttactcgctagaactggtgagaagttcagaggacaaaggcgctcagaggtgtggaatggacggcggaccacacatgggcacttcctgggacacatccgaactgcctcagggccatcaggcccggctaaggacccggagtctgcggttgcctagaaacgacgctagctgcccacccctcttagttttccgcctccgacttccctaagggcatttccggttccggctgcgggccggtgaagatatggcggcgtctgcgtctgcagctgcaggggaggaggactgggtccttccctctgaagttgaagtattggagtccatctatctagatgaactacaggtgattaaaggaaatggcagaacttcaccatgggagatctacatcactttgcatcctgccactgcagaggaccaggattcacagtatgtctgcttcactctggtgcttcaggtcccagcagagtatccccatgaggtgccacagatctctatccgaaatccccgaggactttcagatgaacagatccacacgatcttacaggtgctgggccacgtggccaaggctgggctgggcactgccatgctgtatgaactcattgagaaagggaaggaaattctcacagataacaacatccctcatggccagtgtgtcatctgcctctatggtttccaggagaaggaggcctttaccaaaacaccctgttaccactacttccactgccactgccttgctcggtacatccagcacatggagcaagagctgaaggcacaaggacaggagcaggaacaggaacggcagcatgctacaaccaaacagaaggcagtcggtgtgcagtgtccagtgtgcagagagcccctcgtgtatgatcttgcctcactgaaagcagcccctgaaccccaacagcccatggagctgtaccagcccagtgcagagagcttgcgccagcaagaagaacgcaagcggctctaccagaggcagcaggagcgggggggaatcattgaccttgaggctgagcgaaaccgatacttcatcagccttcagcagcctcctgcccctgcggaacctgagtcagctgtagatgtctccaaaggatcccaaccacccagcacccttgcagcagaactatccacctcaccagccgtccaatccactttgccacctcctctgcctgtggcgacccagcacatatgtgagaagattccagggaccaggtcaaatcagcaaaggttgggcgaaacccagaaagctatgctagatccccccaagcccagtcgaggtccctggcgacagcccgaacggaggcacccaaagggaggggagtgccacgcccctaaaggtacccgtgacacccaggaactgccacctcctgaggggcccctcaaggagcccatggacctaaagccagaaccccatagccaaggagttgaaggtcctccacaagagaaggggcctggcagctggcaggggcccccaccccgcaggactcgggactgtgttcgctgggagcgctctaaaggccggacacccggttcttcctaccctcgcctgcctcggggccagggagcataccggcctggtactcggagggagtccctgggcctggaatctaaggatggttcctagcaggacttggtggggggaacagggaattggggatgggagggaggcaataaagatatttggccttctttggctttctttgcttagcagcgccta

SEQ ID NO: 637 - DNA, 6395 bp, Homo sapiens
atgtctgagagccccaaggacgagggctccgaagagtgtctgtttctgcagcgcctatgggagtggggggcagtggggggaactcagggaagctgcctacaacttgaggccttccccaggctggaggaggaggacagggaaggccgaggggagctgtcctccggctgccatcaccctgatgaggcggccctgccccgggctgtggtctccgcaggggctggcaaccttgcctttgtccagctctctccgtggccaggcctgccatctgcctgcccacactcctccccggcaaagccccttgcaaatgcttgctttggggactggcagctttcgcctctgaatcaggacctagcatcagtactctggggagggggtccaggtgccaaccctgtgagtccctccctgtcccctgacgctgagaaggccctgccaacccccaccatgtgtgaggtgatgcccacaatcaatgagggggaccgcctgggtccccctcatggcgccgatgctgacgccaacttcgagcagctgatggtgaacatgctggacgagcgggagaagttgctggagtctcttcgggagagtcaggagaccttggcggccacacagagccggctccaggatgccatacacgagcgggaccagctccagcgccaccttaactccgccctcccccaggaatttgccaccttaacccgggagctgagcatgtgtcgggagcagcttctagagcgggaggaagagatatcagaactgaaagcagaacggaataacacacggctgcttctggaacatctggagtgcctggtgtcccgccatgaacggtcactgcggatgactgtggtgaagcgccaggcccagtcaccttcgggggtctccagtgaggtggaggtgctgaaggccctcaagtcactgtttgagcaccacaaggccctggatgagaaggtgcgagagcggctccgggcagcgctggagcgagtcaccaccttggaggagcagctggcaggtgcccaccagcaggtgtctgccctgcagcagggggcaggggtgcgggatggagcggcagaagaggaggggactgtggagctggggccgaaacgcctgtggaaggaggatacgggccgggtagaggagctgcaggagctcctggagaagcagaactttgagttgagccaggcccgggagcgactggtcaccctaacaacaaccgtgactgaactcgaggaggacctgggcacggcccgccgggacctcatcaagtcggaggagctgagcagcaagcatcagcgggacctccgggaggctctggcccagaaggaggacatggaagagcggattactacactggagaagcgctacctggctgctcagcgtgaggcaacatccatccatgacctcaatgacaagctggagaatgagctggccaacaaggagtccctgcaccgccagtgtgaggagaaggcccgacacctgcaggagctgctggaggtggcagagcagaagctgcagcagacgatgcgcaaggcagagacgctgccagaggtggaggctgagctggcccagagaattgcagccctcaccaaggctgaagaacggcatggcaacattgaggagcacctgcggcagctggagggacagctggaggagaagaaccaggagctggcacggacggctgtgcaggtgcgccagcgggaaaagatgaatgaggaccacaacaagcggctgtcggacacagtggaccggctgctcagcgagtccaacgagcgtctgcagctccacctgaaggagcgcatggctgccctggaggagaagaacacgttgatccaggagttggagagctcccagcggcagattgaggagcagcaccaccacaagggccgcctgtctgaagagattgagaagctgcgccaagaggtggaccagctgaagggccgaggggggccgtttgtggatggcgtccactccaggtcgcacatgggcagtgcagcagacgtgcggttctccctgggcacaaccacacacgcacccccaggcgtgcatcgccgctactcggcattgagggaagagtctgccaaggactgggagacttctccactgcctgggatgctggccccggcagctggccctgcctttgacagtgaccctgagatctccgacgtggatgaggatgagccagggggtctggtgggctctgcggatgttgtctcccccagcggccactcagatgcccagaccctggccatgatgctgcaggagcagctggatgccatcaatgaggaaatcaggatgattcaggaagagaaggagtccacggagctccgcgcggaggagattgagacgcgtgtaaccagtggcagcatggaagccctaaacctgaagcagctgcgcaagcgtggttccatccccacctctctgacggccctgtccctggccagcgcgtccccaccactcagcggccgctccacacctaagctcacctcccgcagtgctgcccaggacctggaccgaatgggggtcatgaccctgcccagtgacttaagaaagcataggaggaagctgctgtcgccagtgtctcgggaagagaaccgagaggataaagccaccataaaatgtgagacttctcctccttcctcacccaggacgctgcggctagagaagcttggccacccagccctgagccaggaagaaggcaagagtgccttggaggatcagggcagcaaccccagcagcagcaacagcagccaggactccctgcacaagggcgccaagcgcaagggcatcaagtcgtccattggccgcctgtttgggaagaaggagaagggcaggctgatccagctgagtcgggatggagccacaggccatgttctgctaacagactccgaattcagtatgcaggagcctatggtgcctgccaagctggggacccaggcagagaaggaccggcggctaaagaagaaacaccagctgcttgaagatgcccgcaggaaaggaatgccctttgcccagtgggatggtcctactgtggtctcctggttggagctctgggtggggatgcctgcctggtatgtggcagcctgccgggccaacgtcaagagtggtgccatcatgtccgctctgtcggacacagagatccagcgggagatcggcatcagcaatgccctgcaccggctcaagctccgcctggccattcaggagatggtgtcattgaccagcccctctgccccacccacctccaggacttcttctgggaatgtctgggtcacccatgaagagatggaaactctggaaacatctactaaaacaaccctggcctatggggacatgaaccatgagtggattgggaatgaatggctacccagcctggggctcccgcagtaccgcagctacttcatggagtgcctggtggacgcccgcatgctggaccacctcaccaagaaggacctgcgggtccacctgaagatggtggacagcttccatcgaaccagtcttcagtatggcatcatgtgtctgaagaggctgaattatgaccggaaggagctggagaagaggcgagaggagagccagcatgagatcaaggatgtgttagtctggaccaacgaccaggtggttcattgggtccagtctattgggctccgggactacgcaggaaacctgcatgagagtggtgtgcatggagccttgctggccctggacgagaacttcgaccacaacacactggccctgatcctccagatccccacacagaacacccaggcacgccaagtgatggaaagagagttcaataacctgttggccttgggcacagaccggaagctggatgacggggatgacaaggtgtttcgccgcgcgccctcctggaggaagcgcttccggccgcgggagcaccacggtcgcggcggcatgctcagcgcttccgcggagaccctcccggcgggcttccgtgtgtccaccctggggaccctgcagcccccaccggccccgccaaagaagatcatgcctgaagctcactcccactatctctacggacacatgctctccgccttccgggactagccatggcccccagggctggcttcctccttctgggtttcacaggctcctctggccctgacccctcttgctcgttccccttccttccgcagctcctagtctcgtccgtgactttccggttgccctggatctcagaatatattcgtccaccccctcggcaccccattaccccgagtcccaccgtgtgtccgttgtaagtccggtggatgtggctggggtttcctggtattgtggaggcacccaggttgtccatgcttgggattctgggggaaggagagaagggcagctcagggtggatgtgaagccacccttcctcttctggacccagcctggtctgcactgcaacctccaccaggaccaggatcctgggccacaggctgggatggtccttccaagaaagggtcatttcagacgcagccctgcttgggctattcaatcttagggtgtctatccacgtctggctgtgccaaatggtctggcagctggttttggcatccccagcatcaccactctcccaacccatcaccgtgactgcagttcctgcccccattctcttggggtcagggaggggctgggaagggctactgaaggccccattctcccacaggatggtgaggctgggaggaggaagactgaggtagagattccaggccctggcataagctgaatcccaaatttgagtttgggaagaaccagagagaaatggatccctgagctctgagccaagggtgaggatggggaaactctaagctcccacctaataagaagcataggcagaccagccagagggagagccaatggcctctggtagccttaagcccaaagggcagtgggaatgtcccctgccccaaccatcgggtggagctcctgctgggctatggggaagggaggttgtgcggatcttgactctagggcagaacagatctaaccatgcattgctagctctgctcccagcatcccttccccttctctcctcctctgcctcacttctttagtaatcccaaccctataaaaatgaacctaatgggtggattgaatatacattgagcccaaagtcaagtttggggaaaaggcagactaaggcctcctttctctgacctcccaggaagaaaatagcttctcctacagtgattcatgtcccaggtccaggaaatccaatgttggtgaaggcagccactctcttgcttgtccccaaatcacctaaccctcatccagggctattttggtgggcagggactgcctcctcccggaattcctaagatccgcccagctgccaccattttcattgctttccccagcagcatgatgggaacccaagctgagggatacaggtcctgatttggtaggaatattattcccaagaaatacccgctcctcacctactccctcatcctaccaaggtgcctgaaaatgttcaagacttatgttcagggtgggatgatggaaccgagggcttcatcaaagtgagaggaaaggaaaagcatctggcatgtgtttcttggataggggccagtgcagtgccatcctacaggtggctggagcagctgctttgcaacctgatcaccttgagttctgagcagggactaggcttgcaggtgagataatgggccagggcacccagtccagaaggagcaatggcacctgggcagtgccagggcttaaagcccgctgctccttttcggtagaggagaggcccatcactggtgtggtggggtgggctctcccttaggcttgggcaaggcagccacctgcccttgctctcccttagtgttccctggcctccctgccatcaggttgctgggagtggagatggagggattattgagcagaaaatgagttggatggagataaacagctcccatccctgggtaatggatggtaagatgatggagattcctaagattggtggagttgggcaatgcatagccatctgactccttcagggtgctcttgatgggctggctgtaagggagactcagtcccagcctctcccctctacaactcctgccactgttggccatgtcgtaaggcagcagctgtgccaggatagctgggtccattcagagcaccttgagaagtgttgcagggaggtgttaagaagagaactctgtgcaaacagtgatggaaggctgttgtcttggtgtatcccttgcctcatagtcaatatattttttttttggcgagtcaccagtgacccgagccctccacaccagcctcctgtatctcatcaggtcccttctcagtactgtatttgctcagtgcatcaggaatgggtgtatgggtgtgtgtgggtgggtgtgagtgtgggtgtgtacgtaccaataaacaacctggttttaagacaatgt

SEQ ID NO: 638 - DNA, 2190 bp, Homo sapiens
ctcgcgtgcgtccgtatccgggagcagccactaggtaactgtagaggccactgcaattaatcggcttgaacagccaggagcggaaacccgagagtcagttcaaccacagccacccgcgtgtgcccgcggaaagccgatggcctactctcgtccggcagcgcactggtttcctgggttaccggcctcagcgctcctcccgctttcttttccgggaggcgacaatctgacgctctcagcgcgtgacgcagcacgctttgatataaatgcagaccgcgcggccgtagcttcctctctgctctcgcggccgactcgcaagatggcgccgcagaaagacaggaagcccaagaggtcaacctggaggtttaatttggaccttactcatccagtagaagatggaatttttgattctggaaattttgagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttgaacttttgtctcatttttttgagtatgctgtttatatgattttgatttccctctgataactatcaacagtatttaaatagcttatagctggtataattttttcccacgatttccaaaatcttttatgtactcaggtaaaagtagcgttatataggaaatcttttttttagacactctcgttctgtcacccaggctggagtgcagtgactcagcttcctaaatagctggaattacaggtgtgagccaccatgcccggctaattttttgtacttttagtagagtagggtttggccatgttggccaggctggtttcaaactcctgacctcaagtgatctacccacctcggcttcccaaagtgctgattatagctgtgaaccaccatgcccggccaggaaatcttactgtagaacaattttttatatagctgtataaaatgtatatgattgtcttgacagtctcaaatactgtttttaatagcttgtaaatgtaatctcaagtgcttagaacagttcttacatataagttgctctgtagtttgctcttatagttagcccaaagactctgggtgtgaggcctgctgtaaaccaatgttaaactgcttattagaaagccctaaccacctgctttgtaggcaccagaaactcaaaaccaaatctcaactcagctacagaatctactgtggtccttgtctgaaaaaattagttcactcggttggaatcttgtctcagagcatcctcatctctttctcaaaagcccctaccccaacaccggcgtgttggttgtctattgaaacttacaagtggatggaccctttctcccgaataaactggcctttgaaagctctaatcgaaatggtttggcaaaatccatactgcaggagattagggaggacaagaatgatgtgcctttttgtactgctgagcctgatggtggtgccactacttcaggtacttagatgagtcttgatgctaatagaattgtgtcgccaaacatatctggacagttacaacctaatctatgcattaattggtttgggaattgcttgaaattattgtttaattcaatgttttaattcgttttcctaaaaatttaagtgcccccatcatcgtgcaatacctcagtgcagcaactccttgattcttggatgactgaacttcctaacttggctctgccccattgttcccatttttcatgtttttcacaaatagttaaccaggtacctactactgtgcaccgctgcagagcattgaggatgtatgtgatgagtaaaaacacccagcctgctctgctgtgttagtattatgacggaaactgatcaaatcacatgtgaacaaatttactgctacaaaagggagggcttaataaaaggaatttcatctgggaaggcaaa

SEQ ID NO: 639 - DNA, 4306 bp, Homo sapiens
gagatgacaatagggagaatggagaacgtggaggtcttcaccgctgagggcaaaggaaggggtctgaaggccaccaaggagttctgggctgcagatatcatctttgctgagcgggcttattccgcagtggtttttgacagccttgttaattttgtgtgccacacctgcttcaagaggcaggagaagctccatcgctgtgggcagtgcaagtttgcccattactgcgaccgcacctgccagaaggatgcttggctgaaccacaagaatgaatgttcggccatcaagagatatgggaaggtgcccaatgagaacatcaggctggcggcgcgcatcatgtggcgggtggagagagaaggcaccgggctcacggagggctgcctggtgtccgtggacgacttgcagaaccacgtggagcactttggggaggaggagcagaaggacctgcgggtggacgtggacacattcttgcagtactggccgccgcagagccagcagttcagcatgcagtacatctcgcacatcttcggagtgattaactgcaacggttttactctcagtgatcagagaggcctgcaggccgtgggcgtaggcatcttccccaacctgggcctggtgaaccatgactgttggcccaactgtactgtcatatttaacaatggcaaaattgagctccgggccctaggcaagatctcagaaggagaggagctgactgtgtcctatattgacttcctcaacgttagtgaagaacgcaagaggcagctgaagaagcagtactactttgactgcacatgtgaacactgccagaaaaaactgaaggatgacctcttcctgggggtgaaagacaaccccaagccctctcaggaagtggtgaaggagatgatacaattctccaaggatacattggaaaagatagacaaggctcgttccgagggtttgtatcatgaggttgtgaaattatgccgggagtgcctggagaagcaggagccagtgtttgctgacaccaacatctacatgctgcggatgctgagcattgtttcggaggtcctttcctacctccaggcctttgaggaggcctcgttctatgccaggaggatggtggacggctatatgaagctctaccaccccaacaatgcccaactgggcatggccgtgatgcgggcagggctgaccaactggcatgctggtaacattgaggtggggcacgggatgatctgcaaagcctatgccattctcctggtgacacacggaccctcccaccccatcactaaggacttagaggccatgcgggtgcagacggagatggagctacgcatgttccgccagaacgaattcatgtactacaagatgcgcgaggctgccctgaacaaccagcccatgcaggtcatggccgagcccagcaatgagccatccccagctctgttccacaagaagcaatgaggactgcccagtggaggaggggcgatgtggctggggagctagggagagactctggaggtggtgggtctctcgggagacccctaatgaggaagttgaggtaatgcttaacattgttgctgtgagaatttactgccctatgtttcccagagccattttggctcaattcaagtctattcaattcaagttaactctagcccagcccagatcaactcctcctacaaatattattggatgataggccctagaacccaataaaggagctccaaatgtcgttgggtggggaagcaaaatgtagagaaacatttaaagcacactgtaataataaatgcaattataaactatatggaggagggtgcagaggagggaatgtgtctggtgtgtgatgtgtgtgtgtgcagtgggggtatcacagagagtatgacatctgagttgagggtagcaggtgcctggagtctcaggtggctgctcacccatctgtgcaggtgtctctggggctgctggtctcacctgtggtctgcagtagacacaattggctgagcaggatatgtgatactgtgtggttggtgtggagttttgaagaaggggctgtgtttgggccacgtaggctctactcagagacctgaaaccacttcagaatggtgcatatgtcgaaagagctggctgggggccttgcccaaaccaactgaggtcttaaagtccagggaaaaaaagtctgggttccaactagaattctagaaatatttctagaacacacagagagggaataagtccctctatcacccttattaccaagccttgtggttccctgtgattttagataatgtctgatatttttctggctatttgcctagtaggatttaaaaaatattttcaaagtgaagctgagagagaatcttggaaacacacatacctgttgatcatgggccctgcagaattggcccttgggggctttatttggttacatgtgcctgggtggtctttaccagcttagactctatcatgggcccccatgaagctccattctcaatactgaataattattacttcccttgttgagtttctttttctgtcatgccctgggggcttctgctcttctcaccagaaagaacatttgaatctggattcttgtacacctgggttagaccctgttcagaggtgtggccaatttatcccgatctcctggaaggctgttgtgatttccatctaagaaatgagggtcttgagaatcaaccagtcccaagattagcctgttatcctgttatctactgagaccccaaatttctcaccaatgttttgggagatcctggaaaagatcccttcagtttggggtgtcaccaagacttctacacaacccaggactaccattgacctcagagctgtaccccacatcttgaagtaaattgatcccaccaggtcccacgtttgttatctctgcctaaatgttagcttctccatcctcaccacatgatgacctgctgtgtccctctgagcactacccagtggctgaaaactctgcaaatgggccacacttttgcaaaatacttgtatctgacacttaggtcttgtttgaagaatttcctttctggaaggttttacaagaagactgatagtctttcaagcccccacatcacaggcttagggacggcactaactttctcccagggatctaactggctagttcaaattatcactcttttaccttcatataaaatgtctcccccaaacctttttcccttctttgtcattgttatctgctaagcccctggtcatttccccatattcgtagtctttttttccatcctatctttctaatatttgttgtctttaacaaactgtgttctgtgtctgtgctcctccttccctctcagaccactggaatgcaagtccttcttccctttggaatgtactctggatcccttcccctgctttgacccccagactttgctccatctattattgcttctccatcctggatccttgacatttgtcaccccactggccttctcaggtgcaatcagtaaaaatgctgagaactcttggatcttaatcttcatgactgagttttttttagttgtatagttatcatctgcctttcttcactttgcatttcttcttgaatccattgcagattgacttccactcccactccttcactaaaagggctcttaccaagatcaaatctaatgggtacattttagttcctatgtgatttggcctttcgatgtcaatcatcactcccagccattgattttggtgacccacttccctgtgatgatcttctgatctagtttctcaggttccttcgctggtcctttttctttccctgcccctgacatattgacatttcctggagttggttttgtccttgattcattctcatgtcattctgcacacagtctctgcatgaactcaggcagacccttcatttaatgaccaccttagggctgatgattctcaaatctgtattccccgatcttgcatttgagctccagccccactcatcctctcggatgttctgcaggcccagcaaactcatcatgtccaaagtgaaactttttctctttcctgtctcctctcctctgatctgttctttcttggaacaccacccaagaacgtcacctcctccatcagattgtgagctcctggagggcaggagctgtgtccttctattcatcttcctatccccagaaccttgcacagatcctggaatgtggtaggtgctcagtaaatgtgtgttgaataaatgaatgaatgaatgaacaaatgaatgaatttgcttacttcaaggcaaaagaaccatgaaactgtattttgagtttctatgttatagcagtcagcaaatcctattaaatactttgtgtttccaagc

SEQ ID NO: 640 - DNA, 6659 bp, Homo sapiens
ccggcggcgcgggcgagggtgggaatctttttcgggctcccgggggcggagggaagggagcgcgcgtgcgcgcgcccggccggccgtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaagtggttgcttagatttaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccagcccctgctggctctgctggcactcctccccttcctgctacttctgcatctgcccctgctcctcttgttcctgctactgtcccttcctccactgccccagacgctgctgctgggggtgcccagacccttgctgatggcttcacttctccaactccccctgttgtttcttccactccccctacaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaatataactgacacaataaaacacatttcccccatctgtacaataaatacagcttcaaattcagtggagtctgtagggcagataactttaatcatcactactgtagtcagtataagaaatgctgaaaaaaatccaggagggcttgtctctttgtgggtggtcactgtgatgttgggccagctcctgttcaggtccagagctgctaacgtgggttctactcagtcccagtgacttggccagaatagagctttgccaggtaactgccctgtgctaggtgaaaggggaaaagcagtagctggatatatttcaaatgaggttttgaacaagttcagaaagtggaacttgattgaaaagtgaacaagtgtagtagtgtgtgagaaaattcagatggtgtcggatgcagaagttaatattccacttaatgttatctgagcattaaaaatcatcagcatttaactgagaccccactatagagtttccttatcaagactttttggttttaaagttgtttttaatgcattgcaagttacaatagctattttgcttttagatttttcccagcactttgtatttattagctttcattaacttgcctccagtatacattccacttcgtgcttttcttaggtcatttctacatcccttattccttgttttcctgcagtgtaatggccctgaatgtcctctgagccttcagctccattatggacccaaactagactatacttggataagttaagctcttcttcgtgtactggtctataattagaaaaactgttttaaattagatgttcccattatttatttaaacagctttttgctgagaaagcttagtggattaatgaggcagagggtgttttgaaatccaataaatagttcccacaggctgggtgtggtggcttatgcctgtaatcccagcactttcggaggccgaggtgggtggatcatgaggtcaataaattgagaccatcctggccaacatggtgaaaccccatctctactaaaaacacaaaaattagctgggcgtggtggcgcacacctgtagtcccagctacttgggaggctgaggcaggagaatcactggaacctgggaggcagaggttgcagtgagccgagattgtgccactgcactccagcctggtgacagagcgagactccatcaaaaaaaaaaaaaaaaagttcccacagctcaccactacagaagcagggaagacaactatgcagaaaacagagttagtggcggtcagcaggaatgcagctggtcttttggacccctacgggatgggggcagtgcagaagacactggtgaagtcctttatactgaagacctgtggttgggagcaggggtagtccatgggtctgctgattttttttccctatttagtactaatgtgtgtgtgatctttgttttacaaacagtaccttttgggttttctgcatattttataatttttgtacagttttgaattctatagattgtcttggaaggatactgtgtgatgggtcaggcacacagtaattggagacttttaatgtatgtaatatttcatagattgcatgctattaatcatctgtgagggtagtattttttgttttattgtaagtttccctctttttttataaattaaaagatggttggtattaggaatttcaaatgaatgcagaaaatcttacatgctgtgtactattaatattataacagacgatccaagtccaaaatctgaccaataaagcaaccattttatcaagatagagggattctaatgggagaggggattcttccctcctgaagtttgtgtgtccagtccccttaaaaaaaatgaatagttgtcttttcttgtcatattaatactcgaaagtccatggtggtattaatgaaagtacactttattgttgcctttgaacttacggccaaggcaataaatcagaaacaaaaatagtgccaatgtgtcaaaatcgacatctgagagattcagcctcccatttggaataaatatgaatcttctaagctatcttgtttaatattttccatcatttagctacttcctatctccctcagaggcgcctgctgttcccattttagagttgacagtggcctgctaattttgctatgttcctaaaagttactgggtgtgagacattttcatcccctcctttttcctactgctggtgtttattatccagctagacaatattttatgcatatttaccgtgatgtctggaccgtacctgtgctccttggcagtttatgttgaagataactaaagatttttctctttgggaggcatcaaaatgatggtagtttgcttttatctttttatgttcattttcttttagtaggtgacctttctgcattaagaactgtttttatcttttactaccttttcttttctcctttgtggagacagcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtatattca

SEQ ID NO: 641 - DNA, 1430 bp, Homo sapiens
agcagaggacgctgccggcggagacgggaccggaagccgggccgcaggcggccgggcgtattcgccgactcctcccgcttccgctgccgcagccggtcgtaaccaagttgtgtcctgtcagccgctgtccccttcgccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacaacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttctttcca

SEQ ID NO: 642 - DNA, 1223 bp, Homo sapiens
aacgtcgtgcgcatgcgccgacccggcgccattttggtggccgggcgcggaggtgattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactg

SEQ ID NO: 643 - DNA, 2027 bp, Homo sapiens
gtcatttgggaaacaaaaggagaattttacagagagagagggatagctaaaactacgtgagcctggcgagggtgcagagcagaaagtagagactgtccgaagactgctatctgggacgagacaagttgttaaagggacaggagagaaagcagagctatttcaagagtgagccacagaagggaatccagaggccatctaagcgaggaagggtctacaggcagtgagtgaaggccaggagcagggcccaggccaggcacgaccaccgaggggatgaacttcacagtgggtttcaagccgctgctaggggatgcacacagcatggacaacctggagaagcagctcatctgccccatctgcctggagatgttctccaaaccagtggtgatcctgccctgccaacacaacctgtgccgcaaatgtgccaacgacgtcttccaggcctcgaatcctctatggcagtcccggggctccaccactgtgtcttcaggaggccgtttccgctgcccatcgtgcaggcatgaggttgtcctggacagacacggtgtctacggcctgcagcgaaacctgctagtggagaacattatcgacatttacaagcaggagtcatccaggccgctgcactccaaggctgagcagcacctcatgtgcgaggagcatgaagaagagaagatcaatatttactgcctgagctgtgaggtgcccacctgctctctctgcaaggtcttcggtgcccacaaggactgtgaggtggccccactgcccaccatttacaaacgccagaagaaacaggatctcactctgttgcccaggctggagtgcagtggcacaaacacaacttactgcagccttgatctcccgagctcaagtgatcctcccatcttagcctcgcagaacactaagattatagatagtgagctcagcgatggcatcgcgatgctggtggcaggcaatgaccgcgtgcaagcagtgatcacacagatggaggaggtgtgccagactatcgaggacaatagccggaggcagaagcagttgttaaaccagaggtttgagagcctgtgcgcagtgctggaggagcgcaagggtgagctgctgcaggcgctggcccgggagcaagaggagaagctgcagcgcgtccgcggcctcatccgtcagtatggcgaccacctggaggcctcctctaagctggtggagtctgccatccagtccatggaagagccacaaatggcgctgtatctccagcaggccaaggagctgatcaataaggtcggggccatgtcgaaggtggagctggcagggcggccggagccaggctatgagagcatggagcaattcaccgtaagggtggagcacgtggccgaaatgctgcggaccatcgacttccagccaggcgcttccggggaggaagaggaggtggccccagacggagaggagggcagcgcggggccggaggaagagcggccggatgggccttaaggcctgcgccgacccgaccctgctcgagagcccgcgctagagtcggggaggatctgcgcagagaccgcagcatcacccaaatcggcgccggccccgggaggatctcaataaagaactcgagcgtcccagacccgtatctcctttcgctgcccaaccccgcagcctgggcttcgaaggcgacccgcccaccatcctgcccttcccagaacctgagaccgtctggggggcggaagccaaatgaacccctattgggcacctctgtgatgccaggagcgaactggtgagcccagcgccctgggaagagggccgagggcggggcggtggtgccgggacctctgaggtcctggggatttggggacccttggggtccacatgcacctggctgacctggctgaaagccgctgtctcggagccccccacagcattttgttcccctcccgctggcccgggggccccaccttcccacgggttcccacgctgctgtgactgccctgcctctacgacaaaagccaacgggtcttcagtacttttattaaaaaatagtcacgcagaca

SEQ ID NO: 644 - DNA, 518 bp, Homo sapiens
gcagttgttgttggttgggggccttttggccggtgacggagactgcccaggtgtggtcaccatgttcctctccgcggtcttctttgccaagagcaagtcaaaaaacattctggtgagaatggtgagcgaagctgggacaggtttctgcttcaacaccaagagaaaccgactgcgggaaaaactgactcttttgcattatgatccagttgtgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaatagcctgtgc

SEQ ID NO: 645 - DNA, 2919 bp, Homo sapiens
atgcggccggagggcgcgggaatggagctcggaggcggcgaggagcgcctgcctgaggagagcaggagggagcactggcagttgctgggtaatttgaagacgacggtggagggtttggtatcaaccaacagccccaacgtctggtctaagtatggtggcttggagcggctttgcagggacatgcagagcatcctctatcacgggcttatccgtgaccaggcgtgccgccgccagacggattactggcagttcgtgaaagacatccggtggctcagtccccactcagcccttcacgtggagaagttcatcagcgtgcacgagaacgaccagagcagtgctgatggtgccagtgaacgtgctgttgccgagctgtggctgcagcacagcctgcagtaccactgcctctcagcccagctccggcccctgctcggggatagacagtatatcagaaaattctacacagatgctgccttcctgctaagtgacgctcatgtcacggccatgctgcagtgcctggaagcagtggaacagaacaacccccgcctcctggctcagatcgatgcgtccatgtttgccagaaagcacgagagcccgctcctggtgacaaagagccagagcctgacagccctgcccagttccacatacacccctccaaacagctatgctcagcattcctactttgggtccttctctagcctccaccaatccgtgcccaacaatggctcagagagaagatctacttcctttccactctctggccctccccggaaacctcaagaaagcagagggcacgtctcaccagcagaggatcaaaccatccaagcccccccagtttcagtctctgcactagccagggattcccctttgaccccaaatgaaatgagctccagtactctgaccagccccatagaggcatcctgggtcagcagccagaatgattccccaggtgatgccagtgaggggcctgagtacctggccattggcaacttggacccccgaggccggactgccagctgtcagagtcacagcagcaatgccgagagcagcagttccaatttgttctcctccagcagctcccagaagccagattctgctgcctcttccttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccagaatcctgcaatgataaggcgaagttgagaggccctttgccctactctggtcaaagcagtgaagtcagcacacccagctctctgtacatggaatatgaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagctttcgggtcacctccagcagctcccagttcagctcacgtgattcggcacagctctctgactctggctctgctgatgaggttgatgaatttgaaatccaagatgctgacatcagaaggaacacagcctcaagcagcaaatccttcgtttcctcccagtccttctcccactgcttcctgcactccacgtctgctgaggcggtggccatggggctcctgaagcagtttgaggggatgcagcttccagccgcctcggagctggagtggcttgtcccggagcatgatgcccctcagaagctcctgcccattcctgactcactgcccatctcaccggatgacgggcagcacgctgacatctacaagctgcggattcgtgttcgtggcaacttggagtgggccccgccccggcctcagataatttttaatgttcatccagccccaacgaggaaaattgccgtggccaagcagaattaccgctgtgcaggatgtggcatccggactgaccctgattacatcaagcgactgcggtactgtgagtacctgggcaagtacttctgccagtgctgccacgagaatgcccagatggccatccccagccgggttctgcgcaagtgggacttcagcaagtactacgtcagcaacttctccaaggacctgctcattaagatctggaatgatcctctcttcaacgtgcaggacataaacagtgccctctataggaaggtcaagctgctcaatcaagtccggctgctgcgggtccagctgtgtcacatgaagaacatgttcaagacttgccgactggccaaggagcttctggattcctttgacacagtcccaggccacctgacagaggacctccacctgtactcactgaatgacctgactgcgaccaggaagggggagctggggccccggcttgctgagctcaccagggcaggggctacccatgtggagagatgcatgctctgccaagccaaaggcttcatctgtgagttctgtcagaatgaggatgacatcatctttccctttgagctccataagtgccggacctgtgaagagtgtaaagcgtgttaccataaagcctgcttcaagtctggaagctgtccgcgctgcgagcggctgcaggcccggcgggaggcactggccaggcagagcctggagtcttacctgtcagactacgaggaggagcccgcggaagcgctggccctggaagccgccgtcctggaggccacctga

SEQ ID NO: 646 - DNA, 2791 bp, Homo sapiens
ctcccgcgcccaggccagcggcgggcccagctcctcccccgactcggtctctctcccctcccctccgcccggcagttcctccctcccgccgccgcctcttcctcggtgaggcgctcttccagcgggcaggcagcatggcggccgtggagacgcgggtgtgcgagacagacggctgcagcagtgaggccaagctccagtgtcccacttgcatcaagctgggcatccagggctcgtacttctgctcgcaggaatgttttaaaggaagttgggctactcacaagttactacataagaaagcaaaagatgaaaaggcgaagcgagaagtgtcttcctggactgtggaaggtgatattaatactgacccatgggcaggttatcgatatactggtaaactcagaccacattatccactgatgccaacaaggccagtgccaagttatattcaaagaccagattatgctgatcatcccttaggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacacttagcatgtattgcaagaaattgctacccttctcccctgaattattataatttcccaaagtcttgttgtacctcagtgaatgaagtcatttgccatggaataccagacagaaggcccttacaagaaggtgacattgttaatgtggatatcactctttatcgcaatggttatcatggggacctgaatgagacattttttgttggagaagtggatgatggagcacggaaacttgttcagaccacatatgagtgcctgatgcaagccattgatgcagtgaagcctggtgttcggtacagagaattgggaaacattatccagaagcatgcccaagcaaatgggttttcagttgttcgaagctattgtgggcatggaatccacaagctttttcatacagctcccaatgtaccccactatgctaaaaataaagcagttggagtgatgaagtcgggccatgtatttacaattgagccaatgatttgtgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgctttccaggtgaacattggaaatgagaatctttgaaacttagcaatatgtgttgcaccagattttttaaattatatatatggaaatatatatgtatacattttaagttctgtatacataattaccaaacactatgtgacctggagtttgtgttgtttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtttatggcaaaaatagccattttccaagtggtggctgactgttgcagggaatgagaatttcataatacactgctatttcagacctctgtttggtcagaaatggaaaagaaaaagccccctttcttcccttttctgttttacttcaagggcataccttggaggtgctcagagaagcgtgaagtttgcactatggtggaggatggggaaagagttctaaagtgtctccagctgtgaacccaggaggtcaagtgggctattaaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacctcagctgccccatatctacgttcctttcagcagttgtccaagtaggagtgtatccagtgaagacatatcaaatcacaaagtcattgtcattagagtgtacttgattactgggcatccttgtaatataatttcataccactgacacattatacttgtaagagaacatctttcccagagtgcctcagaccttattgctttaaaatataataatgttttcattacttttattatttgaatgatttagtaaagttgactgaatctggtatagactttgggagtatgtgtgtgaagtttttatcaaactgtaatatttgtgaatggaatgccttgcaatatgaatgttaatataatgtgtaaagggagattaaaaagtttgaatgattatcctaccat

SEQ ID NO: 647 - DNA, 1126 bp, Homo sapiens
agcatgcattattaagcgcttgacttgcttccagacaaaggttgtctcaagtttgttgctcaaaccgagttctggagaacgccatcagctcgctgcttaaaattaaaccacaggttccattatgggtcgacttgatgggaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcagcatgtacctgatgatcaaggcattccttcctaaaatgcttgctcagaaatctggcaatattatcaacatgtcttctgtggcttccagcgtcaaaggagttgtgaacagatgtgtgtacagcacaaccaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaatctgcttatgtaactggtaaccctgtcatcattgatggaggctggagcttgtgattttaggatctccatggtgggaaggaaggcaggcccttcctatccacagtgaacctggttacgaagaaaactcaccaatcatctccttcctgttaatcacatgttaatgaaaataagctctttttaatgatgtcactgtttgcaagagtctgattctttaagtatattaatctctttgtaatctcttctgaaatcattgtaaagaaataaaaatattgaactcatagcaggagaatagtttttaaaataaatctcgatttgttagca

SEQ ID NO: 648 - DNA, 4128 bp, Homo sapiens
ttttccagatctttctcgaacccgcagcttcttgggcagccgttgcccgagtgctgacggaagcggccgaagtccgggcccggagctggctcgggcgcggagcggaggctcgcgcgcctcccgggcagccgagcgcgcaggcgcaggtcccagtaaccgccggttggaggcggccgaaccgcagtagggaaagacccaggctgcgggacgcggtgcaggctgcggcgctgacggcctctgctccttccgcgggtttccgactccctgccctagattttctgcttagcgacttggggtcccctctcgtttgcttctggtaggagtcgcaatcccagcagcaatagcccagaagaggacacggttcccgtaccgaagggttcagtaccagcagcccgaccatcacgcggcgggatgtctgtggttggcattgacctcggctttctcaactgctacattgctgtcgcgagaagtggcggcatcgagaccatcgccaatgagtacagcgacaggtgtaccccggcctgtatatcattgggatcaagaactcgagccattggaaatgcagcaaagagccagatagtcacgaacgtaagaaatacaattcatggcttcaaaaagcttcatgggcgatcatttgatgatcccattgtgcaaactgaaaggatcaggcttccctatgaactgcagaaaatgcctaatggaagtgcaggagttaaggtgcggtacttagaggaagagagaccttttgcaattgagcaagttactggaatgctgttagccaagcttaaagagacttcagaaaatgctttgaagaaaccagtggctgactgtgtgatttcaattcctagcttttttactgatgccgagagaagatctgtgatggctgcagcccaggttgcaggcttaaattgtttaaggttgatgaatgaaactactgcagttgcactggcgtatggaatttataaacaggatcttcccccattagatgagaaaccaagaaatgtagtatttattgatatgggacattctgcctatcaggtcttggtttgtgcttttaacaaaggaaaacttaaagtcttggctactacctttgatccatatttgggtggcaggaactttgatgaggctttagtagactacttctgtgatgagttcaagaccaaatataagataaatgtgaaagaaaactctcgggccttgttgcgtttatatcaggaatgtgaaaaactaaagaagctaatgagtgcaaatgcatcagatcttccattgaacattgagtgtttcatgaatgaccttgatgtttctagtaaaatgaacagggctcaatttgaacaactgtgtgcttcccttttggccagggttgaaccacctttaaaagcagtaatggaacaagctaacttacaacgtgaagacattagtagtatagaaattgtaggaggagcaacacgaattcctgcagtgaaagaacaaatcactaaattctttcttaaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaattgggagcttcactattcagaatgtttttccacagtctgatggtgatagttccaaagtgaaggttaaagttcgtgttaacatccatggaatcttcagtgtggctagcgcatcagtaattgagaagcaaaatttggaaggcgatcacagtgatgctccaatggagacagaaacttcatttaaaaatgaaaacaaagataatatggataaaatgcaggttgatcaagaagaagggcatcaaaaatgtcatgctgaacacactccagaagaggaaattgatcatacaggagccaaaacaaagtcagctgtctcagacaaacaagaccgattaaatcagacacttaaaaaaggaaaagtcaaaagtattgatctaccgatccagagtagcctatgtagacaactaggccaagatcttctcaacagctacattgaaaatgaggggaagatgatcatgcaagataagttagagaaagaaagaaatgatgctaagaatgccgttgaagaatatgtatatgattttagagacaggctgggcactgtctatgaaaaattcatcactccagaagacttgagtaaactgtctgcagtattggaagacacagaaaattggctttatgaagacggagaggaccaacctaaacaagtttatgtggataagcttcaagaactaaagaaatacggccagcctattcaaatgaagtacatggagcatgaagagagaccaaaagccttaaatgacttgggaaaaaagatccaacttgtcatgaaagtgatagaagcttatagaaacaaggatgaaagatatgatcatctggatcctactgaaatggaaaaggttgaaaaatgtatcagtgatgccatgagttggctgaatagtaagatgaatgcacagaacaaactaagtctcactcaagatcctgtggtaaaagtttcagaaatagtagcaaagtcaaaggaactggataatttctgtaaccccatcatttacaagcccaaaccaaaagcagaagttcctgaagacaaaccaaaagctaatagtgaacacaatggcccaatggatggacagagtggaactgaaactaaatcagattcaacaaaagacagctcacagcatactaaatcctctggagagatggaagtggactaagtcttaattttaccttcacattaattcaaaccgtgcaagtaaccacggggtccatcttttacatctggtacacacaacagacgctcagttgttcttaaccacttttgtcatttgttttttggagtagttttgaaaagtgttttatattgagtgcacttctgttcatttccattgctgcttatatgcagtgttagccgaattagatttacaagacaatctaagctttccggataattttatatatcaaacatacaggatggatacatagttggcaacagtctaccttatttaaagcttctactgggataaacctcaattcctttattcaggaaaggatactttattgcattattgttgcagaagcatagatttaattgcatctttattttgaaaaacaaatgaaaattgatggggtttaaagctacagaggcactgacctttttctagttattgtattgctacaatttaaatattaaaacaaataagagctttctcaacaaattagtccatctcattgatgtaccacagaaatccaaagctttgctgtcatcacataaatgaattaaatcacatgtgaaagggaacacacccaattttatgttaaggtgaaaccagcagtttgcttcttttattagtaatgtggattgatgttttctcagagtaactcgttgtcttttcgcttgaaatttttgatcttgtcctgaagactagctgctgctaaaacaatgctagcctaaagatacaggagtctctgacaaaatgactttcatgttaaggggaaatgctgtttatctactcagacatgcatctgtgatgttcatagccttgtttcagttataatagttgtcttgtttttttcttaattgattttgttaataataccttaacacagggtaggaagaagtggcacagtgtattgcattatatacatttatcattgatttacctaatgttaccttgtagattaaacactattaagtggtaatacttgaaaaggagcacttataccataagtcttaggaaataatgtttgtaataaacttaactatgttacatatcaacaggcaaaaatatagaatgttacatagtgttgtgtgattaaattatagttcctgctgttaacattaccttttgaaaccttggctccagttttggtgcttcttatacaaattaaatgcgaaaagggactgtaaactt

SEQ ID NO: 649 - DNA, 1898 bp, Homo sapiens
aacggccaccgcagctgccttcggcgccgccagccccgccatggctgcgccctgcgcggaggacccctcgctggaaaggcattttaagggccaccgagatgcagttacctgtgtggacttcagtatcaacacaaagcagctggccagtggctccatggactcatgcctcatggtctggcacatgaagccgcagtcacgcgcctaccgcttcactggccacaaggatgccgtcacctgtgtgaacttctctccttcgggacacctgcttgcttccggctcccgagacaagactgtccgcatctgggtacccaatgtcaaaggtgagtccactgtgtttcgtgcacacacagccacagtgaggagtgtccacttctgcagtgatggccagtccttcgtgacagcctctgacgacaagacagtcaaagtgtgggcaactcatcgccagaaattcctgttctccctgagccagcatatcaactgggtccgctgtgccaagttctcccccgacgggcggctcatcgtgtctgccagtgatgacaagactgttaagctgtgggacaagagcagccgggaatgtgtccactcgtattgtgagcatggcggctttgtcacctatgtggacttccaccccagtgggacgtgcattgccgctgccggcatggacaacacagtgaaggtgtgggacgtgcggactcaccggctgctgcagcattatcagttgcacagtgcagcagtgaacgggctctctttccacccgtcgggaaactacctgatcacagcctccagtgactcaaccctgaagatcctggacctgatggagggccggctgctctacacactccacgggcatcagggaccagccaccactgttgccttttcaagaacgggggagtattttgcttctggaggctctgatgaacaagtgatggtttggaagagtaactttgatattgttgatcatggagaagtcacgaaagtgccgaggcccccagccacactggccagctccatggggaatctgccagaagtggacttccctgtccccccaggcagaggcaggagtgtggagtctgtgcagagccagccccaggagcccgtgagtgtgccccagacactgactagcacgctggagcacattgtgggccagctggatgtcctcactcagacagtctccattctggagcagcggttgacactgacagaagacaagctgaagcagtgtctggagaaccagcagctaatcatgcagagagcaacaccatgatcaggggagcaggaatcaggagctcggtggatttgcaggtggcaggccagggatttgtaccatgggacttgggtaaataaaggggactgaactctgtgggaatcacatccatactggagccctggatttttgcagttctgccctccaccttgctatctgcaccaggaggctctccacctggcagccagaggtccccagtgggccgggctcacacacaaatgatgcttcagacccgaatgagaggaccacattttgcttaatgtaaaggagccacttgaaaatgtctgctccttcggggtcctgagattgtggctccccctctggaggaggtggctccacgatgccttgattttcactcatcatttggacatgtgactggcttttcctacctctgccatggtgtagaaattgattgcacattgattggatgagccgggggttttctctaaatctgactaaaggcccaaagtgggcccatctgagtcaggtttgttgagaacaagccctctcaagtgggtggtggcttttcagtggccctgatttctgttccacacgtgttcactggagccaggtgacttcctccttgcgtgagtgagggcacaggaatctcaaaattaaacctgacttcattgca

SEQ ID NO: 650 - DNA, 4173 bp, Homo sapiens
aggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtaggtttgataaagggagacccagcagcatctttgcccatcatcagctattcttttacctcatactcaccttatgtaacagaacttataatggaatccaatgtagagctcatagcaaaaaatgacttgcgctttatagatgctgtctataagcttcttcgtgatcaatttaattataaaccaattttgacaaaaaagcagtttatccaatgtgggtttgcagaatggaaaatccaaattgtttgtgatattttgaattgtgtgatgaaaaagcacaaggaattaagcagtcttcagaagattccatcacaacaaagaaagaaaatcagttctggtaagtcagaacctcctttgggcaatgagaaaatatctgcagaggctgttggcgttgatatcagtggcaggtttatgacctcaggaaagaagaaagctgtggtgattcgtcacttgtataatgaagataatgttgacatttctgaggatacattaagtccaataacagatgttaatgaagcagttgatgtgtctgacttaaatgctactgaaataaagatgcctgaagtaaaggttcctgaaatcaaggctgagcaacaggatgtaaatgttaatcctgagattactgcactacaaactatgcttgctgaatgccaagaaaatcttaagaaactgacttcgatagagaaaaggttagactgtttggaacaaaaaatgaaaggaaaagtgatggtagatgaaaacacctggactaatcttcttagtcgtgtcactcttcttgaaacagaaatgcttttgtctaaaaagaatgatgaatttatagagtttaatgaagttagtgaagactacgcttcttgtagtgacatggaccttctgaatcctcacagaaaaagcgaagtagagaggccagcaagtattcctctgtcctctggctatagtacagcatcatcagattcaactcccagagcctctactgttaattactgtggtttgaatgagatttcagaggaaacaacaatccagaaaatggaaaggatgaaaaaaatgtttgaagaaactgcagagttactgaaatgtccaaatcactacttgtaggattttctacatgaacttttttctaggactttggttactatacatattgtatattttaagaattctttatacaattttaatatactgcaatactgcagtttttgacaatttggattccatttggtatatgaatttttgcattcattattgaataactcttttaatatttttgagcaatgattatactgctttaccttgtgtcactttttttttttttaggaaaaactcatgttccagtatatttctcttacagagtgaagtcattacagcactgtatttctgtgttgacatttgttggcagtgtgctaagtaatgttttttaaagcacaggcttgaggactatggtttacatcctgttggaaacattccaaatgggacttgtgtattatacccaggaggctctcatatataccatcttggcatctgtactgatgaataagttataatgaacagttaaaaatgctcattgaaaattaaataaaacaaaaaggcagttatttcatgcttggtcaaaaacatcaatacctttccaattaacactgagaaattaaggttaagattctccttttgtactgggaaacaggctggaggactatggtcctcaagtttagaccaagaggactatggtctcaaggttcaccatgagaaatgtgttgaacattttagtatgctctattgtataatttttttggagggggggatggagtttcgctgttgttgcccaggctggagtgcaatagcacgatcttggctcaccgcaacctctgcctaccgggttcaagtgattcttgtgcctcagcctcctgagtagctgggattataggcatgcaccaccatgcccagctaattttgtatttttattagagacagggtttctccgtgttggtcaggctggtctcaaactcctgacctcaggtgatctgcctgtcttggcctccggcgtaacactttttaagaccagtgtaacagaaagagaatgtagccattctagccaccgttaaaagatacacagtgaggtgttgtgttttgtttttttaatgatgaaaagttacacattttttggagagaaaagtcttagctgaaggtaaatcaatggaaaaatgaaatttatttttaatattactactatatgaattatctttttttaaacttgtagataaaagtgttccagtaatcagaaaatcctcaagaaaattgacttcattatttggaaggaaaattagtattttttttaatattatatggaccatctgattatattttatttattcatctatttatggtatgtatgtataattctatattacactgtcaaatataaaatattgttatatgagtagaaatcacttaaattttttttgtgtttgtgaatttgaaacagtgtaagaaatcacttttaagaaaacatttttagaattcctttgttttttttttttttctttttgaaacagggtctcactctattgcccaggctggagtgcactggcgtgatctcggctcactgcaccttctgcctaccgagttcaagcgattcttgtgcttcagcctcctgagtagctgggactataggcctgtaccgtcatgcctggctaatttttgtatttttgtagagacagggtttcaccatgttgcccagtctgttctcaaactcgtgagctaaagctactcgcccacctggatgtcccaaagtgctagattccatgggtgagtcaccatgcttggccacatttttagtattctaataaacagttggtcatcagaactttaaaatggtagcctacagaaacatacaattttgaatttaacagagtttcagtaaatatttccagaattaatgaagcatgttagctttaattttttcaattgtgagagaagtacatttataaaaattaagaggttaagaggttatagttataagggaaaaaacttctgtatcgattaactcctaaaatatcagtaccagcatggaattatagcaccaccttgtggttaacatgccagtattttaccttttgttaaaacaagtgatttcccatcaaacaggataatattttttcccttttgaaaaattcaattttaaaaagaaacatttttgaagttttcttatggaagatagaaaaaaagttaagtctctttctaccctttctttttttctttatatagtgcagatatacacacagagaagggacttaaaacatttctaatctcctagtttatatacagtgtgcaaaatataagtaagtatatattgaaaatataaaatatttcatatatgttatcaggtggaaatttagaatccaaattttcttaaactttaataacttgtctaacaactctctaatagggactaaaaatcaactcaatatatcatacatttacacttacaaagagtctttatctagacaacataatttttggaaaaataaagcaaattcaactttattggagttattggacagatcagcaaattgttattttaaaaagttttcttgtttaggcaatttggtaagtggtttctagttataaactagccactgttgattaacttgagaaggtgaagcaggggagttctgaagagattacctagagctacataaccctaagttaagtaaaattttcactttcattcttttcattctctcataaactggttgaaaaaacactgtactaccaacaaaggtgtcagttgcttgtgctgccctgtctatgttatgctctgaataggtctcggtaaagattatatggaaatactataaagaatacataaggtaaaatactagtcagaaagggttcagaagaagttagcatcaactgtatgaaaattctaggtaaagctaagtactattgagttggaaaaaagtaattctatcatgtttgcttgttttcctctactgtttttaatgtgatgttgtaatatattttaaaaataaaacttgaaaacgttggga

SEQ ID NO: 651 - DNA, 6208 bp, Homo sapiens
gtgttaggaagcgtgacccgggtgggaaaaccctccgcgtccgccattttggctgcctctgtcggtctgttcagttaccacgtgaaccgccgacggagacccgtagtgggggaggcggcggcagcgttaagtgagaaaggaaaaaagacaacgaggaaaaaggaggtgtccgggtagggcaacgcggcgacacccgaggcctggtggtggcggcggatcgagatattcaaggctgaagcagctacggaacggcagcggcggcggtcggacaaactgactgaccgagccgggtggtggcgggagcagcgggagcagccggaacgatgccggccgtgagcctcccgcccaaggagaatgcgctcttcaagcggatcttgaggtgttatgaacataaacagtatagaaatggattgaaattctgtaaacaaatactttctaatcccaaatttgcagagcatggagaaaccttggctatgaaaggattaacattgaactgtttggggaaaaaggaagaagcttatgaattggttcgtagaggtttgagaaatgacttgaagagtcatgtgtgttggcacgtttatggccttcttcagaggtcagacaagaagtatgatgaagccattaagtgttacagaaatgcactaaaatgggataaagacaatcttcaaatcttaagggacctttccttactacagattcaaatgcgagatcttgagggttacagggaaacgaggtatcagttacttcagcttcgacctgcgcagagagcatcatggattggttatgctattgcttaccatttattagaagattatgaaatggcagcaaagattttagaagaatttaggaaaacacaacagacatcccctgacaaggtggattatgaatatagtgaactactcttatatcagaatcaagttcttcgggaagcaggtctctatagagaagctttggaacatctttgtacctatgaaaagcagatttgtgataaacttgctgtagaagaaaccaaaggggaacttctgttgcaactatgtcgtttggaagatgctgcagatgtttatagaggattgcaagagagaaatcctgaaaactgggcctattacaaaggcttggaaaaagcactcaagccagctaatatgttagaacggctaaaaatttatgaggaagcctggactaaatatcccaggggactggtgccaagaaggctgccgttaaactttttatctggtgagaagtttaaagaatgtttggataagttcctaaggatgaatttcagcaagggttgcccaccagtcttcaatactttaagatcattatacaaagacaaagaaaaggtggcaatcatagaagagttagtagtaggttatgaaacctctctaaaaagctgccggttatttaaccccaatgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaacatcagcggtagagaatttgaatgaaatgcagtgcatgtggttccaaacagaatgtgcccaggcttataaagcaatgaataaatttggtgaagcacttaagaaatgtcatgagattgagagacattttatagaaatcactgatgaccagtttgactttcatacatactgtatgaggaagattacccttagatcatatgtggacttattaaaactagaagatgtacttcgacagcatccattttacttcaaggcagcaagaattgctatagagatctatttgaagcttcatgacaacccccttacagatgagaataaagaacacgaagctgatacagcaaacatgtctgacaaagagctaaagaagctacgtaataaacaaagaagagctcaaaagaaagcccagatagaagaagagaaaaaaaatgcagaaaaagaaaagcagcagagaaatcagaaaaagaagaaggatgatgatgatgaggagataggaggtccaaaagaagaacttattccagagaaactggccaaggttgaaactccattggaagaagctattaaatttttaacaccgttgaagaacttggtgaagaacaagatagagactcatctttttgcctttgagatttactttaggaaagaaaagtttcttttgatgctacaatcagtaaagagggcatttgctattgattctagtcatccctggcttcatgagtgtatgattcgtctctttaatactgcagtgtgtgaaagtaaagatttatctgatacagttagaacagtattaaaacaagaaatgaatcgtctttttggagcaacgaatccaaagaattttaatgaaacttttctgaaaaggaattctgattcattgccacacagattatcagctgccaaaatggtatattacttagatccttctagtcagaagcgagctatagagttggcaacaacacttgatgaatctctcactaacagaaacctccagacatgtatggaggtattggaagccttgtatgatggtagcctaggagactgtaaagaagctgctgaaatttatagagcaaattgtcataagcttttcccttatgctttggctttcatgcctcctggatatgaagaggatatgaagatcacagttaatggagatagttctgcagaagctgaagaactggccaatgaaatttgaacatcactaaacaagcaaatggaatgactttggaccatatctagtatataatatttttgtcacgcacctgctgcattgctctaacttacacagaatgagaggagtaaatgttcttgccttcaaatagtgttttacgttttttatcctgctgaaaaagtatatataaaatatctaacattacaggatagaggttcagtttcttaaaaaattaaagctgctaaaattgagtggttaaaaaagataccttatcctattcctccccacccacccatgtttttaaactaatttatataaaatctggaggctgttacagctaacaaagcaggtgtgtggcagaaatattactttaaatttgtcttgtgagattttactatatctcagacagcataaatgctgttttagcactggattctttcactgagcacaaagagttgttggggctttagcatctgactgattttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaaacttgaagaactaaaacaacaatgcaaacctttcagcattgtttggccaaacttgttaaaactgtaatgcaagaaccaaatgcactgtgatgtggcaccaactaattagcaagcatgaatttttcacccaagagtgaaaaaaggaaaatctaccatggcttgaagttaaagagcagaactcctgactaccattctatgactgatcaaaagactaatagttaaaaacctcagcaggccttgttcacgatatgcagaaaaaaaagtgctgcagtttagatacctctggaatttttccacagtgtcacaggtttgtaatacttgaagccctacatttctaagaatatatttcttgctcagttgtttcaggcaagcccaagactttgtaatttttaaagggcccaagattttttttttttttttttttttcaaataacagaccagcttctttttcttgcagttacagatgtaatttcctttttgttgtcaaacataaggtaccaaatatgatgcaataaattgttttgaaaaacagttgtgtgaatatttcaactaatctgtgttgggcttctgtgaaatacacaggtggaaacagaggtgcaagccagaggcaatgtaatatgctgtaaggctagtgcagatgggagctttttagaaggggctaagtgctggtgtcagggaaattccataatgaagtagaatgctgctcctgcattaagatttcattgagggcaaggctggtggcaggtactatgaatgtaattcataatttaaaaggaaaactaaaaactattttgatttgggaaaatgagccttaatttgttaaacctatacactgagaactagcctcaggcttaatattctcattgcatttgcaagatctgagcaaataagattaagtaaaacaaatcaattgtatatataattgacctttttgtggaacatgtagtttatagaaagtatactctaaagggaatttgccgaagaccttttactgattgaacagttgtgctacaatcaacttttcatagtacatgacctgcattccacatctcagtctaacagtttagtagtgatgtaaagagaagtacaaaccgaactccagtgctttgttatgttttattaactggccctgtctcaggaacatcttaacagatggcaaaaaaacaaaaactttttttcaactcctatgagtggcaactgaagttcttattgttgggaaagaacactagtcctacctctgccactaatgaggtgtttggaggaggtaccagccatataatagggggtgtatgtgtgaattttgtttaaactctactgtatattgaaatgaaattcatttatttgtcttgacaatgttcaaatgatgtagattgtcttagaatgaatattcataagtactcagaactcttaagatgcagatgccacccgtgaggagctaaattcctaatgtgtattgtattccaacccaattttactggaactattgaataaatcttttattttctttcaggtttacttgatagtggatacattggtgtcagaggaccttgactgggttcattttatgtccagacatcacccctgaaacactgtactgtactatcttgctctgagtagtatcaactggatcgtctcatatttgcctcattcatcctattaatttcaaatgatactgtgggggaaaaacagggttagaaaaacaagtggaaaaaatggagtgatgttgtaatctaaacaagtgccttatgtttattgctaagaactggtgttaccaacccttttgagaagaaagggtctcttgacctgtattaacataggaaagtaaagttctttttgtttttctttatattcagctactcttgtcatttctcgttgaaaaactaaaatctgactaggttagtttactcagctttaattagatagttgagtcatatattttcaacatttttctgtatcgtatttattatgcacaaaaataaagtgtgatctctaatagcatggctaaaggtaatgccaatattagtgaatagctttgctgtgggctttatcaggcccttgtttttcacagtgttgtttgtactccatggtgtattgctattagagctgtgaaatgaaagctgtgactttatgaagagatcaaaaaaagtgtggtccagattcaggtaggttgtggtaagttcagggaagtcttgtatgatttctaagaatatttcagttaccatgtatagtatttgggaaaagctgtaatgtaaaatattggactttgttgcaagataggtatatacttgtgtcagataattaaagccttaaattttgaaatgaatctttgagatttcaaagaaagactgacctttcaaatagaaggcggtctttctattctagctaatgccccacttctttaagttataaacaaagtttcatgataccattctgctatcatctaaactttgctgaactctactgccaacctacattaaaaacaaagtcccacgaaatggctgtgttacaccatagtgagcagaaacttaaattttgttctaattttgatggttgaaaaatttcaacctgtagcaataaa

SEQ ID NO: 652 - DNA, 1872 bp, Homo sapiens
gaataaacaccgggtgcctagaggagaagagatggagccccagccttggtcccctttcccacccttcctccccacaaggctgtctgagatgccaccttccacctaaacatcatctcccaaattttaatccttaactttggtctctgacttctgcttgattccacagtctccacccacatttgcacaaaggaccatcacctgtccttcctggaatctctaaagttttctgctttccttctgtcctgatggccagctctgctaagtcagctgagatgcccaccatctccaaaaccgttaaccctactcctgatcctcatcaagaatatctggaccctaggattaccattgccttattcgaaattggatcacattccccttcctcctggggctctctccctttcctaaagaatagcagccatcaagttacagaacaacagactgcacagaagtttaacaatctcttaaaagaaattaaagatattcttaaaaatatggcaggttttgaagagaagatcacagaagcaaaagaactttttgaggaaaccaatattactgaggatgtgtcagcccacaaagaaaatatcagaggacttgacaaaatcaatgaaatgttatcaacaaacctgcctgttagtttagccccagagaaagaagacaatgaaaagaaacaggagatgatattggaaaccaatattactgaggatgtgtcagcccacaaagaaaatatcagaggacttgacaaaatcaatgaaatgttatcaacaaacctgcctgttagtttagccccagagaaagaagacaatgaaaagaaacagcagatgataatggaaaaccagaactctgagaacaccgcacaagtttttgcaagagatttggtaaatcgtttagaagaaaaaaaagtccttaacgaaactcaacaaagtcaggaaaaagcaaaaaacagacttaatgttcaagaagaaactatgaaaattaggaacaacatggagcagttactacaggaagcagaacactggagtaaacaacatactgagctcagtaaactgataaaatcctatcagaaatctcagaaagacataagtgaaactcttggaaataatggagtcggtttccaaacccagccaaataatgaagtgtcggctaagcatgagctggaggaacaggtgaagaaactgagccatgacacctattcattgcagttgatggcagctttgctagagaatgaatgccaaatcttacagcagagagtagagattctcaaggaactccatcatcagaaacagggaactctgcaagagaagccaattcagataaactataaacaggacaagaaaaatcagaagccatcagaagcaaagaaagtagaaatgtataagcagaacaagcaagcaatgaagggtacattttggaaaaaagacagatcctgtagaagcctggatgtttgtcttaataagaaagcttgcaatacccagttcaatattcatgttgcaagaaaagctcttaggggaaaaatgaggtcagctagcagcctaagatagaaaataccaaaagcagatgaaaaggtgaatccttaaaaaactacatctgttacctccaacttgtcagtcatgatcaatcatcaaaccttgggcagatctgctggttcaaccaagaaagagctatagaataaggagattgacacttatattactcattacttcagcagttatgtaagtctggtctttaatgaccattgtgtctacatcaagttcataacttttcacctttacaatctgcttgttttttttgtaattattagatagacagcctagagtgagaagttaaaggtccaattaagtaaagatctaaataaaaaccagaatacaagggaaa

SEQ ID NO: 653 - DNA, 7505 bp, Homo sapiens
gttgtgactgaaacccgtcaatatggcggcgatcggccgcggccgctctctgaagaacctccgagtacgagggcggaatgacagcggcgaggagaacgtcccgctggatctgacccgagaaccttctgataacttaagagagattctccaaaatgtggccagattgcagggagtatcaaatatgagaaagctaggccatctgaataactttactaagcttctttgtgatattggccacagtgaagaaaaactgggctttcactatgaggatatcataatttgtttgcggttagctttattaaatgaagcaaaagaagtgcgagcagcagggctacgagcgcttcgatatctcatccaagactccagtattctccagaaggtgctaaaattgaaagtggactatttaatagctaggtgcattgacatacaacagagcaacgaggtagagaggacacaagcacttcgattagtcagaaagatgattactgtgaatgcttccttgtttcctagttctgtgaccaactcattaattgcagttggaaatgatggacttcaagaaagagacagaatggtccgagcatgcattgccattatctgtgaactagcacttcagaatccagaggtggtggcccttcgaggtggactaaacaccatcttgaaaaatgtgatcgattgccaattaagtcgaataaatgaggccctaattactacaattttgcaccttcttaatcatccaaagactcgacagtatgtgcgagctgatgtagaattagagagaattttagcaccctatactgattttcactacagacatagtccagatacagctgaaggacagctcaaagaagacagagaagcacgatttctagccagtaaaatgggaatcatagcaacattccgatcatgggcaggtattattaatttatgtaaacctggaaattctgggatccagtctctaataggagtactttgcataccaaatatggaaataaggcgaggtctacttgaagtgctttatgatatatttcgtcttcctctacctgttgtgactgaggagttcatagaagcactactcagtgtagatccagggaggttccaagacagttggaggctttcagatggctttgtggcagctgaggcaaaaactattcttcctcatcgtgccagatccaggccagacctcatggataattatttggcactgatactctctgcatttattcgtaatggacttttagagggtctagttgaagtgataacaaacagtgatgatcatatctcagttagagctaccatccttttaggagagcttttacatatggcaaacacaattcttcctcattcacatagccatcatttacactgcttgccaaccctaatgaatatggctgcatcctttgatatccccaaggaaaagagactgcgagccagtgcagccttgaactgtttaaaacgcttccatgaaatgaagaaacgaggacctaagccttatagtcttcatttagaccacattattcagaaagcaattgcaacacaccagaaacgggatcagtatctccgagttcagaaagatatatttatccttaaggatacagaggaagctcttttaattaaccttagagatagccaagtccttcaacataaagagaatcttgaatggaattggaatcttatagggaccattcttaagtggccaaatgtaaatctaagaaactataaagatgaacagttacacaggtttgtacgaagactactttatttttacaagcccagcagtaaattatatgccaacctggatctggattttgccaaggccaaacagctcacggttgtaggttgccagtttacagaatttcttcttgaatctgaagaggatgggcaaggctacttagaagatctagtaaaggatattgttcagtggctcaatgcttcatctggaatgaaacccgaaagaagtcttcaaaataatggtttattgaccacccttagtcaacactactttttatttattggaacactttcttgccaccctcatggagttaaaatgctggaaaaatgcagtgtatttcagtgtctccttaatctttgctccttgaaaaaccaagatcacttgctaaaacttactgtttctagcttggactatagcagagatggattggctagagtcatcctttccaaaattttaactgcagctactgatgcctgcagactctatgcaacaaaacatttaagggtattattgagagctaatgttgaattctttaataattggggaattgagttgttagtgacccagctacatgataaaaacaaaacgatttcctctgaagctcttgatatcctcgatgaagcatgtgaagacaaggccaatcttcatgctctcattcagatgaaaccagcgttatcccaccttggagacaagggtttgcttctcctgctgagatttctctccattccaaaaggattttcctatctgaatgaaagaggttatgtagcaaaacaattggaaaagtggcacagggaatacaactccaaatatgttgacttgattgaggaacaactcaatgaagcacttactacttaccggaagcctgttgatggtgataactatgttcgtcggagtaaccaaagattacagcgtcctcacgtctacctgcctatacacctttatggacaactagtacaccataaaacaggctgccatttgttggaagtacagaatattattacagaactctgtcgtaatgttcgtacaccagatttggataagtgggaagaaattaaaaaactgaaagcatctctttgggccttgggaaatatcggctcatcaaattggggtctcaatttgctacaggaagaaaacgtgattccagatatactaaaacttgcaaaacagtgtgaagttctttccatcagagggacctgtgtatatgtacttgggctcatagctaaaaccaaacaaggctgtgatattctaaaatgtcacaactgggatgctgtgaggcatagtcgcaaacatctgtggccagtggttccagatgatgtggaacaactctgtaatgaactttcatctatcccaagcactctaagtttgaactcggagtcaaccagctctagacataatagtgaaagtgaatctgtgccatcgagtatgttcatattggaggatgaccggtttggcagcagctctactagcacatttttccttgatatcaatgaagatacagagccaacattttatgaccgatctggacccataaaggataaaaattcattccctttctttgcttctagtaaacttgtgaagaatcgtatcttaaattcgcttactttgcctaacaaaaaacatcgtagtagcagtgatccaaaaggagggaaattatcatctgaaagtaagacaagcaacaggcgaatcagaacacttacggagcccagtgttgattttaatcatagtgatgattttacacccatatccactgtacagaaaacattacaattagagacttcatttatggggaataagcacattgaagacactggtagtacaccaagcattggagaaaatgacttaaaattcaccaagaattttggtacagagaatcacagagaaaatacaagccgagagaggttagtagtagaaagttcaacgagctcacatatgaagatacgtagccaaagtttcaatacagacactacaacaagtggcataagttcaatgagctcaagtccttcacgagagacagtaggtgtagatgctacaactatggacacagactgtggaagcatgagtactgtggtaagtactaaaactattaagacaagccactatttgacgccacagtctaaccatctgtctctctccaaatcaaattcggtgtccctggtgcctccaggttcttctcatacgcttcctagaagagcacagtcccttaaagcaccctctattgctacaattaaaagtctagcagattgtaactttagttacacaagttctagagatgcttttggctatgctacactgaaaagactacagcaacaaagaatgcatccatccttatctcactctgaagctttggcatctccagcaaaagatgtgctatttactgataccatcaccatgaaggccaacagttttgagtccagattaacaccaagcaggatcgattttaaaaagaagcatgtcgggggaatcaggagcttaagacctacaataacaaacaaccttttcaggttcatgaaagccttaagttatgcatcattagataaagaagatttattgagtcctattaatcaaaataccctgcaacgatcttcctcagtgcggtccatggtgtccagtgccacatatgggggttcagatgattacattggtcttgctctcccggtggatataaatgatatattccaggtaaaggatattccctattttcagacaaaaaacataccaccacatgatgatcgaggtgcaagagcatttgcccatgatgcaggaggtcttccatctggaactggaggtcttgtaaaaaattcttttcacttgctacgacagcagatgagtcttacggaaataatgaattcaatccattcagatgcctctctgtttttagaaagtacagaagacactggactacaggaacatacagatgataactgcctttattgtgtctgtattgaaattctgggtttccagcccagcaaccaactgagtgcaatatgtagtcattcagactttcaagatattccatattctgattggtgtgagcagactatccataatcctttagaagtggttccctctaagttttcggggatttctggatgcagtgatggggtgtctcaagaaggctcagctagcagcaccaaaagcacagaattgttactaggtgttaaaacaattccagatgatacaccaatgtgccgtatactccttcgcaaagaagttctaagattagtcattaatttgagtagttcagtttcaactaaatgtcatgagactgggcttttaacaattaaggagaagtatcctcaaacatttgatgacatatgcctttactctgaggtttcccatttgctgtcacactgcacattcagacttccgtgtcggaggttcatacaagaattatttcaagatgtacagtttctacaaatgcatgaagaagcagaggctgtgttggcaacaccaccaaagcaacctatagttgatacatctgctgaatcctgacctcatatttatgatggatatagatacatactatatatattcatatttgtggatttcctaaaagcctcagaaaatacgactgactaggcagcaaagacaggagtatcttctgtacactgttccgcagttactggtacatgaacagttggaactgctgactttcctaaccaaaacaacttccttctctcctttgttgagccttttgaggggttcatgattcattaccacagttttaagagtttcagttaccattgtatgcaagagccaagcactgaatacctacataggttttctattttctttcattttaaaagcataatgacagtggaacaataatgggatatgcagaagcacccttcacaagttatttctgaatgatttttagggtaaataatacagatgccttgtttgttaactaacttgtggaaagcaggaatcagtgtctctaaggctgcatcctattaccacaatggggtgtgctataactgctggtattagagagggaactttggccctttcacgtttttcttaatgtttgtaacactacttcagaggtttataacctcaaagcagaagaagagcctcaacaacccgggacttataagttatttttatgttactagacttgcataaagattcttgttttccaactcttcattttgttgcaatgtgttattacaggatatatgaaccaattaaggtttttcactacagttcttgaataaaatttaaaaatcattttttattttaattaaaaatatttcccatttatagaatgcatatatttgcaatggacttccactttcatcaactttccatctcatcgctttaaacaggaacttgaacaagcactgttagtttagacctaaaggataggaaagcattaaataatactttggatctcctgaggaaaagataagtttgcttgcaatttacacattccatggggaaagaagagccatatttccttaaaaaaaacattaataaagcttgttattgagaaaaattgtagtgaaaagccttaagtaccaaattttaaagcagcagtaacttaatttttatatcagtgtttttgttttgcacaaactaaatgcagtggtaggtgggtttatgagtatattaattgcctttatccatttgtgaagttaagttgatgagggcaaggtttttgtttgtttaatttgtatatgtctaaaggtatttggaactttttacaggaattaaacatatatgcaaatttgtatataaaaatagcatggccatcatttgaatgcttgtaaatgaaaggattatcttttttgagatctatatataaatagaaatagaaaatccagctggactgattaggattcttttttaattcatttgtgtataacatttttattacaattacacatcagttttgacacagtcatagcaacattaatattttcccatgatgcagatcctttttgtaatgggcttgttctttgagatctctgtaaagaaccctgtgaactagaaaacataactcacagagatacttttttaaaaaatttatttactggaactgaaagttccagttgggatgaagcatttcatctcacttcataacacctctttgactgcacttcagtgaattgttcttatgtgcactgtgtagcaacttacattataacaaagcagataagggctgtaagctgctgcttatgttgaaaagtggttcttcagattttctctcataaaatccagttgaagataaataatttttttatactttatcactgaacccaagtgtttatttaaatgtcaacagtacttctaagaacgttgcctgtcatcgtggtctttggtcttggataactaaactgcctttccagagaaccaaatgtcagagttactagaccaaatagtggttaaaacctccaaaggaagtaatgtaatcttattcataatgggattaacatattttagacattcattttaaacactacctcagttaatatagagtataaaaatctgtggtttaatccctcaaaagttaacagtaattttttttttgtcttacacacacacacaccccctcccccaccatcactatccctgtaccctcaccttggtcatctatcctgaaataaggcttagttagtattggcctgaatgttttgtgtttttttttttgttttttttttttactgttactttgaaaaatatgtatgtataccttatcatatctgcctatatcacttactttggggagatactcagagctttgtggttatcagtatactaaaaaaaaaaaaaa

SEQ ID NO: 654 - DNA, 3793 bp, Homo sapiens
tagtcccctggtgaggcttaagctcttgtctgttctggtcttttttttttttttttaacttcctaaaattctccgattctaaaagaaagctcctaaatagaagccaaaaagtagccgcccaacttgaaactccccacaagccgggtaaatagcgcgatacgcagcagctagagttctcgcgtttcccacggcgcaggagcactggagggcccccctccgcccccggccccgccaggaaattagtgcgcatgtgccggtcatccggaagttaccgcagtggccgccggaattaggcgaaaagccggaagtaaacattacgagattggcttggattctgtcggatggacttggggctagctgcggcggggctggaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggtacaagaggggtgtaaaagagaattccataattactaagtaccgcaaaggagcatgtgaaaattgtggggccatgacacacaaaaagaaagactgctttgagagacctaggcgagttggagccaaatttacaggtactaatatagctccagatgaacatgtccagcctcaactgatgtttgactatgatgggaagagggatcggtggaatggctacaatccagaagaacacatgaaaattgttgaagagtatgccaaagttgatttggcaaaacgaacattgaaagcccagaaactccaagaggaattagcctcaggaaaattagtggaacaggctaattctccaaaacaccagtggggagaagaggaaccaaattctcagatggaaaaagatcataatagtgaagatgaggatgaagataaatatgcagatgatattgacatgcctggacagaattttgactccaagagacgaattactgtccggaatctcaggattcgagaagatattgcaaaatatttgaggaatttagatccaaattctgcctactatgatccaaaaactagagcaatgagagagaatccttatgccaatgcaggaaagaatccagatgaagtgagttatgctggagataactttgttaggtacacaggagataccatttcaatggctcagacacagttgtttgcatgggaagcctatgacaagggatctgaagtgcatctacaggcagatcctacaaagctagagctgttgtataagtccttcaaagtcaaaaaagaagatttcaaagaacagcagaaagaaagcatcctggaaaagtatggtggccaagaacatttggatgcccctccagctgaattgcttttagcccagactgaagactatgtggagtactcaagacatgggacagtcatcaaaggacaggagcgggctgttgcctgctctaagtatgaggaggatgtgaagatccacaatcacacacatatctggggatcgtactggaaagaaggccgatggggatacaaatgctgtcactcttttttcaagtattcctattgtactggagaagctgggaaggagattgttaactctgaggagtgtattataaatgagataactggggaagaatctgtgaaaaaacctcaaaccctcatggagctgcatcaagaaaaactgaaagaggaaaagaagaagaagaaaaagaaaaagaagaagcatcgaaagagcagttcagatagtgatgatgaagaaaagaagcatgaaaaattgaaaaaggcactgaacgcagaggaggcccgccttcttcatgtcaaggagaccatgcagattgatgagaggaagcggccttacaatagcatgtatgaaactcgagaacctactgaagaggaaatggaggcatatagaatgaaacgtcagaggccagatgaccccatggcctctttccttggacagtagcaactagtcagaagaccatccaagatagatgcagctgatacattcttttcagcttcttattgatgattgtagatagaaaaatccttgtttattcttcttgctgcctggctttaataaatatttcagatgcctcacagtaagttcactcctttccatactgaggaaacaagaaaagaagaagaggcacatgaagtgtgcttttgggaatagaatttaaaattggattaagattttatttccagttttttttatttatttatttttttttttgagacggagtcttgctctgtcgcccaggctgaagtgcggtggcgcgatctcggctcactgcaagctccacctcccaggttcacgccattctcctgcctcagcctccctagtagttgggactacaggcgcccgccaccatgctcagctaattttttgtatttttagtagagacggtttcatcgtgttagccaggatggtctcgatctcctgaccttgtgatccacccgcctcagcctcccaaagtgctgagattacaggcgtgagccaccgcgcctggcctatttccagttttatgtgagtcatgtaaaaaagccttggctctctacctattaagaatgtctctttctctgtatttattaagcttcaaactttattgcttcgatttttgtggccctatatttagtattagcacaccttggttttgagaaaaaaacagggctttgtttttttaaataattactagcaactctgtgactacatttatttttattttttttagagacaggatcttgctatgttgcccaggctagagagcagtggcttttcacagacaaagtcataatgccctgcagtcttgggctcaagcgattctctcttccttggcctctggagtagactaaatgtgttagtctttgaatggaaaacaactattttctcatcattgggtcaatattgactgatcagtagtaggtcttttaccattctggacataagtctaggtgtagaaatcctttcctttatcatagaggatatggtttacattaccgtttgttttcattgtgattgcccctatgtaacaatcatgaatattagattttttaaattgtagaatatcctaatatttatagccagcagctgttactttgtttgtaaaatttgcaaaaaaacaaaacctgaagttggtttattgaaagaattataaggatagcttctagggatattagtaatagattgccatgatcctgaagcctcttctcagaacactgtgaagataatactgacagtagaatcagtgaaaacagcctaacaaaacctctgacatcagtatatcaacttttaacagcccactcactggcttttctaaactaccaaaaaccacctgtaggatactgcattaagtcagcatctcagaaacagtggtgtgagtaactgagtcaaattgtcaagtactttggatatacatagtgtcgagctttagattggtatgaaattaaacagcaatgcaaatagatttaattcctatttactttaagaatgaaaaacaatgttcattttcctacctaaacagggtggttcaacataaaggctgatgttgtgtccgttttgtattttatcttttgttaaagatacataaatgacaatacttaactgtga

SEQ ID NO: 655 - DNA, 4288 bp, Homo sapiens
gctggcgagtgtaccctttctgcagaaagtaaaaatggccttattcagtaagttaaatttatgttgctatttctttacgacaccggaaaacaaacatttcaaacaccatgctgagaactcagtccttgttttggggagggatgcacttggaagattcgagctaaggtacaatcctccctaggtatccgcgggtcattgttttcaggacccccacagataccaacatccgccatgctcaagccccttacattatgtgggggtgcacggtgggtccttcccatccgcaggttcggcatccgtggatggggagtggatacagagggcggactatacagcttgaaaggcttccctggaagcaatatgtagagtggattgtggaggagcaagaacagaagcggggaggcttgtccagagcatacaggggaaggatgtacggccaagggaggaatcccagacgaccgcgatacgtgacatatttatgtttgcacgaaaataaagtttggaagaaaagtgttgggggaacaagggattcattttcccggggtagttggaatgcaatgggacgcctcaggccgctgggacaggctggcctccgcgcgggggcgcccgagcagccgagccgccgggccttccggctgccccgccggaagtgctctcctgacccgccgctgtgcagcgcagcgcaccgcgggaagatggcgttggaggtcggcgatatggaagatgggcagctttccgactcggattccgacatgacggtcgcacccagcgacaggccgctgcaattgccaaaagtgctaggtggcgacagtgctatgagggccttccagaacacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcaggaacagaatcaagatgcagtggccactgaacttggtatcttgggaatggagggcactattgacagaagcagacaatccgagacctacaattatttgcttgccaagaaacttaggaaggaatctcaagagcatacaaaagatctagacaaggaactagatgaatatatgcatggtggcaaaaaaatgggatcaaaggaagaggaaaatgggcaaggtcatctcaaaaggaaacgacctgtcaaagacaggctagggaacagaccagaaatgaactataaaggtcgatacgagatcacagcggaagattctcaagagaaagtggctgatgaaatttcattcaggttacaggaaccaaagaaagacctgatagcccgagtagtgaggattattggtaacaaaaaggcaattgaacttctgatggaaaccgctgaagttgaacaaaatggtggtctctttataatgaatggtagtcgaagaagaacaccaggtggagtttttctgaatctcttgaaaaacactcctagtatcagcgaggaacaaattaaggacattttctacattgaaaaccaaaaggaatatgaaaataaaaaagctgctaggaagaggagaacacaagtgttggggaaaaagatgaaacaagctattaaaagtctaaattttcaagaagatgatgatacatcacgagaaacttttgcaagtgacacgaatgaggccttggcctctcttgatgagtcacaggaaggacatgcagaagccaagttggaggcagaggaagccattgaagttgatcattctcatgatttggacatcttttaagtacattttcaacagtttgaggactaagcctttctaaaataacattgtaataaaccatttttactgagattgcaacgttttgcactgataaacatgagaatctggaggaaagacaattgttttcttgtttaaaatatgtgtggaaaggaatgcaattgatagaacatttaaagatatatctgacaaaatacttaagagtatatagcacaggatttaatttctcaatctgttgcatgtgctaattatgagtattactagttgataatcagttttgtctaggtcataacataccatttgtaagtttgtttgctttttcaggtttatctttgcagtgaattatgctttgctttaaaacattccgctaaaatcataatgggacatataaattattaagctgttagaaatgcattcaaatttgttttttctgtgttctaagaactcaggcaattttaaggataaaaactaacattggccaggcacggtggctcacgcctgtaatcccaacactttaggagaccaaggcgggcagatcacttgaggtcagaagtttgagaccagccaggccaacatggtgaaacttcatctctactaaaaatacaaaaactagccaggtgtggttctccatgcctataatcccggctactcgggaggctgaggcaggagaatcacctgaacccgggaggcaaaggttgcagtgagctgagatcgtaccactgtactccagcctgggcgacagagcaagactctgtctcaaaaaaaaaaaaaaatacaattaagaggtgtatactgatgattcttcccactcatttgtttgtccagaagtaaataaatgtcggaagttttccaagtaactatttgttttttggggggttttttagttagagtcttgatctgtcacccaggctggagtacagtggcaggatctcagcttactgcagcttccatctcccaggttcaagcgatcatgtgcctaagcctcctgagtagctgggatcacaggtgtgtaccaccacgcccagctgatttttgtatttttagtaaagactttcgccatgttgtccaggctggtctcgaactcctggcctaatgatctgcccacctctgcctcccaaagtgctgggatcacaggcatgagccaccgaacccagccttattctgcttaaatttaacgtgttttttgacttcttaattaacttggtcatatactaaatgtgatctcctgtggattaccacatgcattaaaaaatttttcaagctgggcctagtggcgcacacctgcaatcccaacactttgggaggccaagagaggaagattgcttgagcccaggagtttgagaccaatctaggcaatgtagtgagaccctgtctctaatttaaaaaagaaaaagaaaaaaacattcccagtggcagcctgcctaagactgtcttaccttatgttaaggaagtcaggtatttaaaatgttacatatgccggcgcagtggctcatgtgtgtaatcccagcactctgggaggctgagacaggtagatcatttgaggtcaggagttcaaaaccaacctggtctacatggtgaaaccccatctcaactaaaaatacaaaaaatacaaaaaattagccgggcgcggtggctcacacctgtaatcccagcactttgggaggtggaggcgggtggatcacaaggtcaagagatcgagaccatcctggccaacatggtgaaaccctgtctctattaaaaatacaaaaattagctgggcgtggtggcgcatgcctgtagtcccaactactagggaggctgaggcaggagaatcacttgaacccaggaggtggaggttgcagtgagccgagatcacgccactgcactccagcctggcgacagagcgagactccctctcaaaaaaaaaaaaaaaaatacaaaaaattagccgggcattgtggtgcatgcctgtaatctcagctatttgggaggccgaggcaggagaatcacttgaacccaggaggcagaggttgcagtgagtcgagatcgtgccactgcactccagcctgggtgacagagcaagactttgtctcaaaaataataatagtaaaatgttacatgtgcatgaagttttaaattactcatttttattaatgaagaaaataaggtagtttagacattccaagagttaactatagtttacaaaaatatattaagcaaaaatatgcttgatatattaagcagaaatgttgtatattaagcaaaaatgtaaaattcagcaattataaactgttccttacagacagtgtacttgaagtcttttggtagttctgagaatgtggtcattgaagttggatctaagaggaaagtggttatcggttgctttttatttataaaggatgcaaaaataaaattagatttttggcagtccttaa

SEQ ID NO: 656 - DNA, 1151 bp, Homo sapiens
ggagggggcatcagtgtggggtgggagcaggaaggctgttggggaaggaagctgagagatcctctgcaggaggggattatagcagctaagggcacctgccaggctggaggtgtggcctgtctaggggaagggtggtcactgatgtccagcaggagcccttgacaggtagagcccaccacggcatctccaagaccacaccatgttcctgttctcccgtaagaccaggacccctatcagtacctacagtgactcctacagggctcccacctccatcaaggaggtctataaggacccacccctgtgtgcctgggaagccaacaagtttctgactccgggtctgactcataccatggagcgacatgtggatcccgaagccctgcagaagatggccaaatgtgctgtacaggactacacttatagggggtccatatcaggccacccctacttgcctgagaagtactggctttctcaagaggaagcagacaaatgcagcccaaactacctgggcagtgactggtacaacacatggaggatggaaccttacaacagcagctgctgcaacaagtataccacctaccttcctcggctgcctaaggaggccaggatggagacagcagttcgaggaatgcccttggaatgccctcctaggccggagcggctcaatgcctacgagcgcgaagtgatggtgaacatgctgaactcactgtcgcggaaccagcagctgccgcggatcacgccccgatgcgggtgcgtggacccgctgcccggccgcctgcccttccatggttacgaaagtgcttgctcgggccgccactactgtctgcgcgggatggactactacgccagcggggcgccctgcaccgaccgccgcctgcggccttggtgccgggagcaaccgactatgtgtacctccctacgagcaccggcccggaatgcagtgtgctgttacaactcccccgccgtcatactacccatatccgaaccttagatgggacacaagtcacttcaagaagtctggtggtccccagagaaacaactatgttatccatcctgagtttgtgtctgagacctatcccgactatcgttgctggtagagcctgggcttgctgtgccaagggggcagagcaataaataaactcttcaaccccaaa

SEQ ID NO: 657 - DNA, 4653 bp, Homo sapiens
agagcgaagctgaggagtccagcgctcgccgacaggggcctgggctgtcccgagccggaatccagatcttacataagatggaagtctctcacactagatactgaacattaaatagaaaatctatttagtaaaatctaagttgccatggaagaaataccagtaaaagttgctgtaagaattagacctctgctttgcaaagaagctcttcataatcatcaagtttgtgtgagagttattccaaacagccagcaagttatcattgggagagatagagtcttcacttttgattttgtttttggcaaaaattccactcaagatgaagtttataacacatgtataaagcccctagtgttgtcactcattgagggctataatgcaactgtttttgcctatggacaaactggatctgggaagacatacaccattggagggggccatattgcttcagttgtggagggccaaaagggtatcattcctcgagctattcaagaaatatttcaaagcatctctgaacatcctagcattgactttaatgtaaaagtatcttatatagaagtgtacaaggaagacctaagagatcttctagaattggagacatccatgaaggatcttcacatccgagaagatgaaaaaggaaacacagtgattgttggggccaaggaatgccatgtggagagtgcaggtgaagtgatgagtcttttggagatggggaatgcagccagacatacaggtaccactcaaatgaatgagcactccagcagatcacatgcaatttttacaatcagcatttgtcaagttcataaaaatatggaggcagctgaagatggatcatggtattcccctcggcatattgtctcaaagttccactttgtggatttggcaggatcagaaagagtaaccaaaacggggaatactggtgaacggttcaaagaatccattcaaatcaatagtggattgctggctttaggaaatgtaataagcgctcttggggacccacgcaggaagagttcacatattccatatagggatgctaaaattacccggcttctgaaagattctctgggaggcagtgctaagactgtcatgatcacatgtgtcagcccctcctcctcgaattttgatgagtccttaaattctctcaaatatgccaacagagcacggaacattagaaacaaacccactgtaaacttcagccccgagtcagaccgtatagatgaaatggaatttgagattaaattgcttcgagaagctttgcaaagccagcaggctggtgtcagccaaactacccagatcaatcgagaagggagtcctgatacaaataggattcattctcttgaggagcaagtagctcagcttcaaggagaatgtctgggttaccagtgttgtgtagaagaagcctttaccttcctggttgacctaaaagatactgtcagactaaacgaaaagcagcaacacaaactgcaggagtggtttaacatgatccaagaggtcaggaaggctgtcctcacctcatttcgaggaatcggaggcactgcaagtctggaagaaggaccacagcatgttacagttctccagctgaagagagagcttaagaaatgccagtgtgtgcttgctgctgatgaagtagtatttaatcagaaggaactggaggtgaaggaactgaagaatcaagtgcagatgatggtacaggaaaacaaagggcatgctgtatctttgaaagaagcgcaaaaagtgaatagactgcagaatgaaaaaataatagaacaacaacttcttgtggatcaactgagtgaagaactaacaaaacttaacctgtcagtgacttcttcagctaaagaaaattgtggagatgggccagatgccaggatccctgaaaggagaccatatactgtaccatttgatactcatttggggcattatatttatatcccatcaagacaagattccaggaaggtccacacaagtccgcctatgtactctctggatcgaatatttgctggatttcgaacacgaagtcagatgctgttgggtcacatagaagaacaagataaggtcctccactgccaattttctgataacagtgatgatgaagaatcagaaggccaagagaaatctggaactagatgtagaagtcgttcatggattcagaagccagactctgtttgttcccttgttgaattgagtgatactcaggatgaaacacaaaagtcagatttggagaatgaagatttaaagattgattgtctccaggagagtcaagaattgaatttgcaaaaattaaagaattcagaacgcatacttactgaagctaaacaaaaaatgagagaacttacaattaacatcaagatgaaggaagatctgattaaagaattaataaaaacaggtaatgatgccaagtctgtaagcaagcagtattctttgaaagtaacaaagctagagcatgatgcagaacaggcaaaagtcgaactgattgaaacacaaaagcagctacaggagctggaaaacaaagatctttctgatgttgcaatgaaggtaaaattacagaaagagtttcgtaaaaagatggatgctgcaaagctgagagttcaggtcttgcagaagaagcaacaagatagtaagaaactggcatcactgtcaatccaaaatgagaaacgtgctaatgagctagagcagagtgtagatcacatgaaatatcaaaagatacagctacaaagaaaactacgagaagaaaatgaaaaaaggaagcaactggatgcagtaattaagcgggaccagcaaaaaatcaaagaaatacaattaaaaacaggacaggaagaaggtctaaaaccgaaagctgaggaccttgatgcatgtaacttgaaaaggagaaaaggttcgtttggaagtatagaccatctccagaaattggatgagcaaaagaaatggttagatgaagaagtagagaaagttctgaaccaacgccaagaattagaggagctggaagcagacttaaagaaacgggaggccatagtttctaagaaggaggctctgttacaggagaagagtcacctggaaaataagaaattgagatctagtcaggccttaaacacagatagtttgaaaatatcaactcgcctgaacttactggaacaagagttgtctgaaaagaatgtgcagctccagaccagtacagctgaggagaaaacaaagatttcagaacaagttgaagtcctccagaaagaaaaggatcagctccagaaacgcagacacaatgtggatgaaaaacttaaaaatggtagagtgttatcacctgaagaagaacatgttcttttccaacttgaagaagggattgaagctttggaagctgcaattgaatacaggaatgaaagtatccagaatcgccagaagtcacttagagcatcattccataacctctctcgtggtgaagcaaatgtcttggaaaagctagcttgcctgagtcctgttgagattagaactattcttttcagatatttcaataaggtggtgaatttgcgagaagctgaacggaaacaacagttatataatgaagaaatgaaaatgaaagttctggaacgggataatatggttcgtgaattagaatctgcactggaccatctaaaattgcagtgtgaccggagactgaccctccagcaaaaggaacacgaacaaaagatgcagttgctattacatcatttcaaagaacaagatggagaaggcattatggaaactttcaaaacatatgaagataaaatccagcagttggaaaaagatctttatttctataagaaaaccagccgggatcataagaagaaacttaaggaactggtaggggaagcaattcggcggcaactagcaccatcagagtatcaagaggctggagatggagtcctgaagccagaaggaggaggcatgctttcagaagaattaaaatgggcatccagacctgaaagtatgaaattaagtggaagagaaagagaaatggacagttcagcaagcagcttaagaacacagccaaatcctcaaaagctctgggaagatatcccagaattacctccaattcatagttctttagcaccccccagtgggcatatgttaggtaatgagaataaaacagaaacagatgataatcagtttacaaaatctcacagtcgactgtcatcccaaattcaggttgtgggaaatgtgggacgacttcatggtgtcacacctgtaaaactgtgtcgaaaagaattacgtcaaatttccgccttggaactatcattgcgacgttccagtcttggagttggcattggatcaatggctgctgattccatcgaagtatctaggaaaccaagggacttaaaaacttagacattgaataatagaacttttagtagatatgtaaaaagattcctttttctaacctgttaaaaactaaagctcaagttcactacctctttcctcagaataaaggaagaaggggaggaaggaatccctaattcttttatatgctatagatgtgtacatcttctatatatatttggggagttttagtttatattcccatagtaatcaaacatgttttccaatacttgataacatttaaatatttataaatacgcttaaatgtttttccaggcatatttgaagattaaaactagtaatagactaaaa

SEQ ID NO: 658 - DNA, 1008 bp, Homo sapiens
ggagaagctgggactagcaggcagtttttcatgatttttcctcacactgatcactatccaatcagaacaataaacttctaacactcccttactaaaagaacatggttaagggtgagaaaggccccaagggcaagaagatcaccctcaaggtggccaggaattgcatcaaaatcacttttgatgggaaaaagcgccttgacttgagcaagatgggaattaccaccttccccaagtgtattctgcgccttagtgacatggacgagctggaccttagccggaatcttatcaggaagatccctgactccatctccaagttccagaacctccggtggctggacctgcacagcaactacatagacaagctgcctgagtccattggccagatgaccagcctgctctacctcaacgtcagcaacaaccggctgaccagcaacgggctgcccgtggagctgaagcaactcaagaacatccgcgctgtgaacctaggcttgaaccacctggacagcgtgcccaccacactgggggccctgaaggagctccacgaggtagggctccatgacaacctactgaacaacatccccgtgagcatctccaagctccccaagctgaaaaagctcaacataaagcggaacccctttccaaagccaggtgagtcggaaatattcatagactccatcaggaggctggagaacttgtatgttgtggaggagaaggatctgtgtgcggcttgcctgagaaaatgccaaaacgcccgggacaacctgaatagaatcaagaacatggccacgacgacaccgagaaagaccatctttcccaatctgatctcacccaattccatggccaaggactcctgggaagactggaggtgacttggaacctgaccctgaggcagaagggaaagagagagggagggaagagggcagtgggctacctccacaggaaaccaagggctcccctgtggctgcagcagctctttcagccaagcccataaaactcctttccttactt

SEQ ID NO: 659 - DNA, 807 bp, Homo sapiens
ggacgaggggcaacgtatataaatgcgcgcaggcgtagttaagagagcgcattttgacttcgaggcaccgccgacgttactgtgtcgccatggggcgccgtccagctcgctgttaccggtattgtaagaacaagccgtacccaaaatctcgtttctgccgaggggttcctgatgccaagatccgcatctttgacctgggtagaaagaaggcaaaagtggatgagttcccactcggtggccacatggtgtctgatgaatatgagcagctgtcttctgaagccctggaggccgcccgtatttgtgccaacaaatacatggtgaaaagttgtggcagagatggctttcacatgcgagtgcggctccatcccttccatgtcatccgcatcaacaagatgttgtcctgtgctggggctgacaggctccagacaggtatgcgaggtgcctttggaaaaccccagggtactgtagcccgggtccacattggtcaagtcatcatgtccatccgcaccaagcttcagaacgaggagcatgtgattgaagccttgcgcagggccaagttcaagttccctggacgccagaagattcatatctccaagaagtggggcttcacgaagtttaatgctgacgaatttgaagacatggtggccaagaagtgcctcatccctgatggttgtggagtcaagtacgttcccagtcatggccccttggacaagtggcgggttctgcactcatgaaggttttggcagtactgtctccttgggccatgctggtctgacttatgcttactaataaattctgtttactggc

SEQ ID NO: 660 - DNA, 5038 bp, Homo sapiens
atttcaaaatcttatgtcaaagtaagcgcgcagaaaggggtccttgctcttctacactgagccctacggcccccctgtggggaaatactcctgataatcatctcgaaaattgtttcgaccagcaggggtcactatgaaggctgacttgagcccaagacacaatggggcacggtaaccagactggtccgtaagggttccaggaaggaatgcagtttcaagagaacagtttgaatctttattcgaatttgaattttggtacaatgaagagagtcagctgcaacttgacaatcgaaatcttcagaaaagcgacacaaatacgttcgcctcgaggaatattgggtcttctgcgcggccgtagagctccgccaagtgcgcctgcgcggaggagaagtggcgtcgagtccggccgggcagtagaggaacttgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccaagcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaatgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctcatgactcagcttaatcatttctattcatttgtagaccttcaggtttgatcttaattttttccttgtaatctgattcagttctgtaccattttaatttccacctttagtaattaattaccaatatagcacgttagagtatcttaacctataataccagaagcgcattttaggcttaccactaaagactctaacccacttttcctctgtctcttaacagaatggaaaatgatgtcatcattatttccattccttcatgagctataaaacctattaattaaaaaaaaactttttaattgactggacagcacctgcctgtattcagcatgaccacttgctccagcccctacactgaagcattaaggtcaaagtactgaacagttgttggtccctccacactttgtttttccagcttcgtcataatgtgaatattaatgtttaaaaaaaaaaacctttattatattgtatttacaacactaggttacataactatagactactcttgccattaaaaaaaaaaaaatctataatgttttcaaaaa

SEQ ID NO: 661 - DNA, 1566 bp, Homo sapiens
cagtagctcgcgcggtgcctgtcggtagtcgcgtgcggggcggcggggcggcggggcggccggcggcggccatgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattgagtgccacccatatcttactcagaagaatctgatcagtttttgccaatccagagatgtgtccgtgactgcttaccgtcctcttggtggctcgtgtgagggggttgacctgatagacaaccctgtgatcaagaggattgcaaaggagcacggcaagtctcctgctcagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccataactaaaaatcacaaagactatcctttccacatagaatactgaggacgcttccccttccttgtttctgctcagcccagatgcacagacactattggcaatgttgaccctcctctgtcatcacagcgccagggcagctgtgcctgggacaggagccacacagtcagagggggatgtaagagccaccttctctgacaaatctggagaattgagtgtgttctaagtgaaggcaatggggtttctccaagacagcctgtgtggcctctactctgaacaaatacactgatgagtcatcagtgaaatttgccttcacattttaagaaaactttatcttatggagttatttaagccatctacagagctgaggaaacagtgtaatgtgtctctgccccattgcgcagctccacccattgtgccccaggccagcccgcgtcacctacacttccttctgtgccctgccagtgacccccaggttattctaaagcagagtccttcccttcccccagtgagaaggaaaatgggataagtctgggacactgtttcagttcaataaagaggcttttttcttccttaaaaa

SEQ ID NO: 662 - DNA, 2314 bp, Homo sapiens
cctcgccgacggcccaaggcgttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcacc

SEQ ID NO: 663 - DNA, 2072 bp, Homo sapiens
cggggctcgactctaggagttgggctgaggatttccacccgatcctcgaacctccggcccatctcatggacgcccctcccccttcaaacaccctcccccacatttattcccgcgtctgttttaaagatgggtaaactgaggcacagggagccgggccggggagcactgacagaaccagaagcaggttctgcctcccgtcccctcggagggccgacttgccccttctgggtttcgtcgggggtctcagatacgaggaggcccagctggaagccacctgagggtgtcccccgctaagatgcgcaaatgggaaaagcgaggccggggttggggaaagaacttgcccgagccgcagagcgcgtcagccggggaggtcggggcgggggcgacccgcgcgaccgaggatcgggtatctgggcccggcgcggagcctgcagggcggggccgcggcgcgtgctgatgacgcagtcggcgcggcggccctagcgacgcggttactagggagcggcgagccgagacggctacatggacgccactatcgccccgcaccgtatcccccccgagatgccccagtacggggaggagaaccacatcttcgagttgatgcagaacatgctggagcaactcctgatccaccagcccgaagatcccatccccttcatgatccagcacttgcatagagacaacgacaatgtgcccaggattgtaatattaggtccacccgcctcagggaaaacaacaatagcaatgtggctctgcaaacatctgaacagcagtctcctcaccctggagaacctgatcttaaatgagttttcctatacggccaccgaagccagaaggctttatctgcaaaggaagacagttcccagcgcgctgctcgtccagctgattcaggaacgcctggctgaagaggattgcatcaagcagggctggattctggatggcatccctgagacgcgtgagcaggctctgaggatccagaccctggggatcacacccagacacgtcattgtgctgagtgctccagacacggtcctgatcgagagaaacttggggaagagaatcgaccctcaaactggagagatttatcacaccacctttgactggccacccgaatctgaaatccagaaccgtctcatggtgccagaggacatctcagagctggagacggctcagaaactgctggagtatcataggaacatcgtcagggtcattccctcctaccccaaaatcctcaaagtcatcagtgctgaccagccatgtgtggacgtcttctaccaggctctgacctatgtccaaagcaaccatcgtactaatgccccgttcaccccgagggtgctgctgctcgggcctgtgggcagtgggaaaagtctgcaggccgccctcctggcccagaaatacaggcttgtcaatgtctgctgtgggcaactgctgaaagaggctgtggcagataggaccacgtttggcgagctcatccagcccttctttgaaaaggagatggcagttcctgacagcctcctcatgaaggtgctgagccagcgcctggaccagcaggactgcatccagaaaggctgggtgctacacggcgtcccgcgggacctcgaccaggcacacctgctgaaccgcctgggctacaatcccaacagggtgtttttcctgaatgtgccatttgattccatcatggagcggctgactctgagaagaattgatccagtcactggggaaaggtaccacctcatgtacaagccacctcccaccatggagatccaggctcgcctcctgcagaacccaaaggatgctgaagagcaggtcaagctgaaaatggacctgttctacaggaactcagctgacttggagcagttgtatgggtcggccatcaccctcaatggggaccaggacccatacacagtcttcgaatacatcgagagtgggatcattaatcccctgcccaagaaaatcccctgatgggttcagagccaggagcgctgccccagggaaagagttaatcccctgcccccagccccccagcctcggcacagctcccctaaaaagccaataaagcctgctggatacag

SEQ ID NO: 664 - DNA, 1935 bp, Homo sapiens
ggtgggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaacataaggttgacattgattgcagtcagaaggttgtagtttacgatcaaagctcccaagatgttgcctctctctcttcagactgttttctcactgtacttctgggtaaactggagaagagcttcaactctgttcacctgcttgcaggagctgatgcagcagaatgggattggttatgtgttaaatgccagcaatacctgtccaaagcctgactttatccccgagtctcatttcctgcgtgtgcctgtgaatgacagcttttgtgagaaaattttgccgtggttggacaaatcagtagatttcattgagaaagcaaaagcctccaatggatgtgttctagtgcactgtttagctgggatctcccgctccgccaccatcgctatcgcctacatcatgaagaggatggacatgtctttagatgaagcttacagatttgtgaaagaaaaaagacctactatatctccaaacttcaattttctgggccaactcctggactatgagaagaagattaagaaccagactggagcatcagggccaaagagcaaactcaagctgctgcacctggagaagccaaatgaacctgtccctgctgtctcagagggtggacagaaaagcgagacgcccctcagtccaccctgtgccgactctgctacctcagaggcagcaggacaaaggcccgtgcatcccgccagcgtgcccagcgtgcccagcgtgcagccgtcgctgttagaggacagcccgctggtacaggcgctcagtgggctgcacctgtccgcagacaggctggaagacagcaataagctcaagcgttccttctctctggatatcaaatcagtttcatattcagccagcatggcagcatccttacatggcttctcctcatcagaagatgctttggaatactacaaaccttccactactctggatgggaccaacaagctatgccagttctcccctgttcaggaactatcggagcagactcccgaaaccagtcctgataaggaggaagccagcatccccaagaagctgcagaccgccaggccttcagacagccagagcaagcgattgcattcggtcagaaccagcagcagtggcaccgcccagaggtcccttttatctccactgcatcgaagtgggagcgtggaggacaattaccacaccagcttccttttcggcctttccaccagccagcagcacctcacgaagtctgctggcctgggccttaagggctggcactcggatatcttggccccccagacctctaccccttccctgaccagcagctggtattttgccacagagtcctcacacttctactctgcctcagccatctacggaggcagtgccagttactctgcctacagctgcagccagctgcccacttgcggagaccaagtctattctgtgcgcaggcggcagaagccaagtgacagagctgactcgcggcggagctggcatgaagagagcccctttgaaaagcagtttaaacgcagaagctgccaaatggaatttggagagagcatcatgtcagagaacaggtcacgggaagagctggggaaagtgggcagtcagtctagcttttcgggcagcatggaaatcattgaggtctcctgagaagaaagacacttgtgacttctatagacaatttttttttcttgttcacaaaaaaattccctgtaaatctgaaa

SEQ ID NO: 665 - DNA, 1724 bp, Homo sapiens
gagaagtgtgggctacccggccactgccctggagctgtggtgactgctgcgtttttctcccatgcacttgcacgtccaggactcctgggagaacttgggccacactccttccttgccctcttgagctcattcgtcaccctgttgggtgagcacagccctagctcaggccactgggcaagccacaccatccaaagaggaggtcctctgccccaggacccccacaccaccccagctccctgtttcgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagagtttcactttgttgcccacactggagtacagtggcacagtgtcagctcactgcaacctccgcctcccgggttcaagcaattctcgtgcctcagcctcccatgtagctgggattaaatgtgcccgtcaccacacccggctgatttttttttgtattttagtagagacggagtttcaccatgttgccaaggctggtctcgaactcctgagctcaggcaatccacccatctcggacttccaaagtgctaggattacaggcgtgagccaccatgcttagctgattatgtaaacattgttaatacctgagcaagtagtgtccaactttttgtgtttcttggagttattaacagtttttgtcccagctgctcagtttcttttgtaactgttatgtgtgtgtgtgtaacattatcttcatgccccaaaacccatacccgttatcaatcactccccatttcccaccctgtccccagacttaggcaatcccaaatctgatttctgcctcgatggagtttcctattctggacgtttagtataaatggaatcacatg

SEQ ID NO: 666 - DNA, 5314 bp, Homo sapiens
aagcgtcggacgcggcccggcgccgagccatggagcctgagccagtggaggactgtgtgcagagcactctcgccgccctgtatccaccctttgaggcaacagcccccaccctgttgggccaggtgttccaggtggtggagaggacttatcgggaggacgcactgaggtacacgctggacttcctggtaccagccaagcacctgcttgccaaggtccagcaggaagcctgtgcccaatacagtggattcctcttcttccatgaggggtggccgctctgcctgcatgaacaggtggtggtgcagctagcagccctaccctggcaactgctgcgcccaggagacttctatctgcaggtggtgccctcagctgcccaagcaccccgactagcactcaagtgtctggcccctgggggtgggcgggtgcaggaggttcctgtgcccaatgaggcttgtgcctacctattcacacctgagtggctacaaggcatcaacaaggaccggccaacaggtcgcctcagtacctgcctactgtctgcgccctctgggattcagcggctgccctgggctgagctcatctgtccacgatttgtgcacaaagagggcctcatggttggacatcagccaagtacactgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagtgagcacaagcttccagaatgccacctggttaaggaggaatatgaaggctcagggaagccagaatctgagccaaaagagctcaaaacagcaggcgagaaagagcctcagctctctgaagcctgtgggcctacagaagagggggccggagagagagagctggaggggccaggcctgctgtgtatggcaggacacacaggcccagaaggccccctgtctgacactccaacacctccgctggagactgtgcaggaaggaaaaggggacaacattccagaagaggcccttgcagtctccgtctctgatcaccctgatgtagcttgggacttgatggcatctggattcctcatcctgacgggaggggtggaccagagtgggcgagctctgctgaccattaccccaccgtgccctcctgaggagcccccaccctcccgagacacgctgaacacaactcttcattacctccactcactgctcaggcctgatctacagacactggggctgtccgtcctgctggaccttcgtcaggcacctccactgcctccagcactcattcctgccttgagccaacttcaggactcaggagatcctccccttgttcagcggctgctgattctcattcatgatgaccttccaactgaactctgtggatttcagggtgctgaggtgctgtcagagaatgatctgaaaagagtggccaagccagaggagctgcagtgggagttaggaggtcacagggacccctctcccagtcactgggtagagatacaccaggaagtggtaaggctatgtcgcctgtgccaaggtgtgctgggctcggtacggcaggccattgaggagctggagggagcagcagagccagaggaagaggaggcagtgggaatgcccaagccactgcagaaggtgctggcagatccccggctgacggcactgcagagggatgggggggccatcctgatgaggctgcgctccactcccagcagcaagctggagggccaaggcccagctacactgtatcaggaagtggacgaggccattcaccagcttgtgcgcctctccaacctgcacgtgcagcagcaagagcagcggcagtgcctgcggcgactccagcaggtgttgcagtggctctcgggcccaggggaggagcagctggcaagctttgctatgcctggggacaccttgtctgccctgcaggagacagagctgcgattccgtgctttcagcgctgaggtccaggagcgcctggcccaggcacgggaggccctggctctggaggagaatgccacctcccagaaggtgctggatatctttgaacagcggctggagcaggttgagagtggcctccatcgggccctgcggctacagcgcttcttccagcaggcacatgaatgggtggatgagggctttgctcggctggcaggagctgggccgggtcgggaggctgtgctggctgcactggccctgcggcgggccccagagcccagtgccggcaccttccaggagatgcgggccctggccctggacctgggcagcccagcagccctgcgagaatggggccgctgccaggcccgctgccaagagctagagaggaggatccagcaacacgtgggagaggaggcgagcccacggggctaccgacgacggcgggcagacggtgccagcagtggaggggcccagtgggggccccgcagcccctcgcccagcctcagctccttgctgctccccagcagccctgggccacggccagccccatcccattgctccctggccccatgtggagaggactatgaggaagagggccctgagctggctccagaagcagagggcaggcccccaagagctgtgctgatccgaggcctggaggtcaccagcactgaggtggtagacaggacgtgctcaccacgggaacacgtgctgctgggccgggctagggggccagacggaccctggggagtaggcaccccccggatggagcgcaagcgaagcatcagtgcccagcagcggctggtgtctgagctgattgcctgtgaacaagattacgtggccaccttgagtgagccagtgccaccccctgggcctgagctgacgcctgaacttcggggcacctgggctgctgccctgagtgcccgggaaaggcttcgcagcttccaccggacacactttctgcgggagcttcagggctgcgccacccaccccctacgcattggggcctgcttccttcgccacggggaccagttcagcctttatgcacagtacgtgaagcaccgacacaaactggagaatggtctggctgcgctcagtcccttaagcaagggctccatggaggctggcccttacctgccccgagccctgcagcagcctctggaacagctgactcggtatgggcggctcctggaggagctcctgagggaagctgggcctgagctcagttctgagtgccgggcccttggggctgctgtacagctgctccgggaacaagaggcccgtggcagagacctgctggccgtggaggcggtgcgtggctgtgagatagatctgaaggagcagggacagctcttgcatcgagaccccttcactgtcatctgtggccgaaagaagtgccttcgccatgtctttctcttcgagcatctcctcctgttcagcaagctcaagggccctgaaggggggtcagagatgtttgtttacaagcaggcctttaagactgctgatatggggctgacagaaaacatcggggacagcggactctgctttgagttgtggtttcggcggcggcgtgcacgagaggcatacactctgcaggcaacctcaccagagatcaaactcaagtggacaagttctattgcccagctgctgtggagacaggcagcccacaacaaggagctccgagtgcagcagatggtgtccatgggcattgggaataaacccttcctggacatcaaagcccttggggagcggacgctgagtgccctgctcactggaagagccccagaaacacttgactcttctggagatgtgtccccaggaccaagaaacagccccagcctgcaacccccccaccctgggagcagcactcccaccctggccagtcgagggatcttagggctatcccgacagagtcatgctcgagccctgagtgaccccaccacgcctctgtgacctggagaagatccagaacttgcgtgcagcttctcctctcagcacactttgggctgggatggcagtggggcataatggagccctgggcgatcgctgaatttcttccctctgcttcctggacacagaggaggtctaacgaccagagtattgccctgccaccactatctctagtctccctagcttggtgccttctcctgcaggagtcagagcagccacattgcttgccttcataccctggaggtggggaagttatccctcttccggtgctttcccatcctgggccactgtatccaggacatcactcccatgccagccctccctggcagcccatgttctcctcttttctcaccccctgactttccctgagaagaatcatctctgccaggtcaactggagtccctggtgactccattctgaggtgtcacaagcaatgaagctatgcaaacaataggagggtgtgacaggggaaccgtagactttatatatgtaattactgttattataatactattgttatattaaatgtatttactcacactttgcctctaaggagctagagtagtcctctggattaaggtgataaataacttgagcactttccctcaaccagcccttaactagaacacagaaaataaaaccaagactggaaggtcccctctacccctcccaggcccagagctagctgactgtgtatgagcctgggagaatgtgtctcctccacagtggctcccagaggttccacacactctctgaagctccttctcccacactgcacctactccttgaggctgaactggtcacagacaaactgggatccagcacagtccagcagttctcaaaatgaggtcctcaggccacagtgcgtgaga

SEQ ID NO: 667 - DNA, 5919 bp, Homo sapiens
gagccgccaccgcggccggagctgtcccttagccagacccggcgagacacgagcggcgggagggaggcggtggcgcgcccggccccgcccgcccgaccaagcgtcggacgcggcccggcgccgagccatggagcctgagccagtggaggactgtgtgcagagcactctcgccgccctgtatccaccctttgaggcaacagcccccaccctgttgggccaggtgttccaggtggtggagaggacttatcgggaggacgcactgaggtacacgctggacttcctggtaccagccaagcacctgcttgccaaggtccagcaggaagcctgtgcccaatacagtggattcctcttcttccatgaggggtggccgctctgcctgcatgaacaggtggtggtgcagctagcagccctaccctggcaactgctgcgcccaggagacttctatctgcaggtggtgccctcagctgcccaagcaccccgactagcactcaagtgtctggcccctgggggtgggcgggtgcaggaggttcctgtgcccaatgaggcttgtgcctacctattcacacctgagtggctacaaggcatcaacaaggaccggccaacaggtcgcctcagtacctgcctactgtctgcgccctctgggattcagcggctgccctgggctgagctcatctgtccacgatttgtgcacaaagagggcctcatggttggacatcagccaagtacactgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagtgagcacaagcttccagaatgccacctggttaaggaggaatatgaaggctcagggaagccagaatctgagccaaaagagctcaaaacagcaggcgagaaagagcctcagctctctgaagcctgtgggcctacagaagagggggccggagagagagagctggaggggccaggcctgctgtgtatggcaggacacacaggcccagaaggccccctgtctgacactccaacacctccgctggagactgtgcaggaaggaaaaggggacaacattccagaagaggcccttgcagtctccgtctctgatcaccctgatgtagcttgggacttgatggcatctggattcctcatcctgacgggaggggtggaccagagtgggcgagctctgctgaccattaccccaccgtgccctcctgaggagcccccaccctcccgagacacgctgaacacaactcttcattacctccactcactgctcaggcctgatctacagacactggggctgtccgtcctgctggaccttcgtcaggcacctccactgcctccagcactcattcctgccttgagccaacttcaggactcaggagatcctccccttgttcagcggctgctgattctcattcatgatgaccttccaactgaactctgtggatttcagggtgctgaggtgctgtcagagaatgatctgaaaagagtggccaagccagaggagctgcagtgggagttaggaggtcacagggacccctctcccagtcactgggtagagatacaccaggaagtggtaaggctatgtcgcctgtgccaaggtgtgctgggctcggtacggcaggccattgaggagctggagggagcagcagagccagaggaagaggaggcagtgggaatgcccaagccactgcagaaggtgctggcagatccccggctgacggcactgcagagggatgggggggccatcctgatgaggctgcgctccactcccagcagcaagctggagggccaaggcccagctacactgtatcaggaagtggacgaggccattcaccagcttgtgcgcctctccaacctgcacgtgcagcagcaagagcagcggcagtgcctgcggcgactccagcaggtgttgcagtggctctcgggcccaggggaggagcagctggcaagctttgctatgcctggggacaccttgtctgccctgcaggagacagagctgcgattccgtgctttcagcgctgaggtccaggagcgcctggcccaggcacgggaggccctggctctggaggagaatgccacctcccagaaggtgctggatatctttgaacagcggctggagcaggttgagagtggcctccatcgggccctgcggctacagcgcttcttccagcaggcacatgaatgggtggatgagggctttgctcggctggcaggagctgggccgggtcgggaggctgtgctggctgcactggccctgcggcgggccccagagcccagtgccggcaccttccaggagatgcgggccctggccctggacctgggcagcccagcagccctgcgagaatggggccgctgccaggcccgctgccaagagctagagaggaggatccagcaacacgtgggagaggaggcgagcccacggggctaccgacgacggcgggcagacggtgccagcagtggaggggcccagtgggggccccgcagcccctcgcccagcctcagctccttgctgctccccagcagccctgggccacggccagccccatcccattgctccctggccccatgtggagaggactatgaggaagagggccctgagctggctccagaagcagagggcaggcccccaagagctgtgctgatccgaggcctggaggtcaccagcactgaggtggtagacaggacgtgctcaccacgggaacacgtgctgctgggccgggctagggggccagacggaccctggggagtaggcaccccccggatggagcgcaagcgaagcatcagtgcccagcagcggctggtgtctgagctgattgcctgtgaacaagattacgtggccaccttgagtgagccagtgccaccccctgggcctgagctgacgcctgaacttcggggcacctgggctgctgccctgagtgcccgggaaaggcttcgcagcttccaccggacacactttctgcgggagcttcagggctgcgccacccaccccctacgcattggggcctgcttccttcgccacggggaccagttcagcctttatgcacagtacgtgaagcaccgacacaaactggagaatggtctggctgcgctcagtcccttaagcaagggctccatggaggctggcccttacctgccccgagccctgcagcagcctctggaacagctgactcggtatgggcggctcctggaggagctcctgagggaagctgggcctgagctcagttctgagtgccgggcccttggggctgctgtacagctgctccgggaacaagaggcccgtggcagagacctgctggccgtggaggcggtgcgtggctgtgagatagatctgaaggagcagggacagctcttgcatcgagaccccttcactgtcatctgtggccgaaagaagtgccttcgccatgtctttctcttcgagcatctcctcctgttcagcaagctcaagggccctgaaggggggtcagagatgtttgtttacaagcaggcctttaagactgctgatatggggctgacagaaaacatcggggacagcggactctgctttgagttgtggtttcggcggcggcgtgcacgagaggcatacactctgcaggcaacctcaccagagatcaaactcaagtggacaagttctattgcccagctgctgtggagacaggcagcccacaacaaggagctccgagtgcagcagatggtgtccatgggcattgggaataaacccttcctggacatcaaagcccttggggagcggacgctgagtgccctgctcactggaagagccgcccgcacccgggcctccgtggccgtgtcatcctttgagcatgccggcccctcccttcccggcctttcgccgggagcctgctccctgcctgcccgcgtcgaggaggaggcctgggatctggacgtcaagcaaatttccctggccccagaaacacttgactcttctggagatgtgtccccaggaccaagaaacagccccagcctgcaacccccccaccctgggagcagcactcccaccctggccagtcgagggatcttagggctatcccgacagagtcatgctcgagccctgagtgaccccaccacgcctctgtgacctggagaagatccagaacttgcgtgcagcttctcctctcagcacactttgggctgggatggcagtggggcataatggagccctgggcgatcgctgaatttcttccctctgcttcctggacacagaggaggtctaacgaccagagtattgccctgccaccactatctctagtctccctagcttggtgccttctcctgcaggagtcagagcagccacattgcttgccttcataccctggaggtggggaagttatccctcttccggtgctttcccatcctgggccactgtatccaggacatcactcccatgccagccctccctggcagcccatgttctcctcttttctcaccccctgactttccctgagaagaatcatctctgccaggtcaactggagtccctggtgactccattctgaggtgtcacaagcaatgaagctatgcaaacaataggagggtgtgacaggggaaccgtagactttatatatgtaattactgttattataatactattgttatattaaatgtatttactcacactttgcctctaaggagctagagtagtcctctggattaaggtgataaataacttgagcactttccctcaaccagcccttaactagaacacagaaaataaaaccaagactggaaggtcccctctacccctcccaggcccagagctagctgactgtgtatgagcctgggagaatgtgtctcctccacagtggctcccagaggttccacacactctctgaagctccttctcccacactgcacctactccttgaggctgaactggtcacagacaaactgggatccagcacagtccagcagttctcaaaatgaggtcctcaggccacagtgcgtgagaacttgcttggctgtttgttaaatgctaattcttgggccccatcagagctactgcatcgaaacctgggggtaaaacccaatattctgcatttcttatcaaactctttgggtgataactaagtgtctgaagaggtgactatttcctgacagaaggacccaaagagggaagcaggacataggtaggcagacagacacagggccctgtgcctcaagacacctgtttattggggacacgactctgcaatagggatgacaggaatcgtaccaaaaatagcgacgtctacagggcccctgatggggctagaagggtacagtgccccccaccctcaccccttgtacaaaaataaactctcacgcctatgga

SEQ ID NO: 668 - DNA, 3389 bp, Homo sapiens
cttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatggcctatcagtttatcttcagctgtgcacagacagatagaagccatcaacagagactttcactcttgcctgggctggatgcagtggcgcggcctcagctcactgcaacctccacctcccagattcaaggattctcctgcctcagctttccgagtagctgggattacagattcacatatgctgagtttaccacatcttaggagcagacagcttctttatgatgagttggatgaagtaaacccacgtcttcgagaaccccaagagctcttttccattttgtctaccaagaggccactgcaggctccaagatggccaattgaatgtgaggtcatcaaggaaaacatccatcatattgagtgggctccacctcaaccagaatatttctatcagcctaaaggaaatgaaaaggtaccagagattgtaggagagaaaaaaggaacagttgtctatcaattagattcagtgcctatagaaggttcctattttaccagttccagagtgggaggcaaacgaggaattgtcaaggaacttgctgtcacgttgcaaggaccagaagataatactctactgtttgaatcaaggtttgagagtgggaatctgcaaaaagctgtcagagtagacacctatgagtatgaactcaccttgcgaactgacctctacactaacaaacacactcagtggttttattttcgtgttcagaacaccagaaaagatgctacctatcgcttcaccattgtcaacttgctaaaacccaagagtctttatactgtagggatgaagccactcttgtactcccaattggatgccaacacccgcaatattggctggaggagagaaggaaatgaaatcaagtactacaagaacaacacggatgatgggcagcagcccttctactgtctcacgtggaccattcagtttccatatgaccaggacacttgcttctttgcacacttctacccatatacatacactgatttgcaatgctacctcctgtcagtggcaaacaaccctatccagtctcagttctgcaagctccaaactttatgcaggagcctagcaggaaataccgtttacttgctcaccatcaccaacccatcccagacccctcaagaggcagctgcaaagaaagctgtggtcttgagtgccagagttcaccctggagaaagtaatggctcctgggttatgaaaggctttttggacttcatccttagcaactccccagatgcccagctcctcagagatatttttgtcttcaaggtgcttcccatgttaaatccagatggtgtgattgtggggaattatcggtgttccttggccggaagggatttgaacaggcattataaaaccattctgaaggagtctttcccttgtatttggtacaccaggaacatgatcaaaagacttcttgaagaaagagaggttctgttgtattgtgatttccatggccacagtcgtaagaataatatcttcctgtatggctgtaataacaacaatcgcaaatactggcttcatgaacgagtctttcctttaatgttatgcaaaaatgcaccagataagttctcttttcacagttgtaattttaaggtccaaaaatgcaaagaaggaacaggacgagttgttatgtggcggatgggaatcctaaacagctacaccatggagtctacctttggcgggtccaccctgggtaataaaagagacacccactttaccatcgaagatctgaagtccttaggttatcatgtctgtgacacccttctggacttttgtgatcctgaccaaatgaagttcactcagtgtctagcagagcttaaggagcttttacgacaggaaatccacaagaaattccatgaacttggacaagatgtagatttagaaggaagttggagtgacatctctttgtctgacattgaatccagcaccagtggctctgacagttctctctcagatggtcttcctgttcacctagcaaacatagcagatgagctgactcagaaaaagaagatgtttaagaagaaaaaaaagaagtcacttcagactaggaaacagcgaaatgagcagtatcagaaaaaaaatttgatgcagaagttaaagttaacagaagatacctcagaaaaggcaggatttgcttctactctgcaaaagcagccaacctttttcaaaaactcagagaattccagttttttaccaatgaaaaatgaaaacccaaggttaaatgagacaaatttaaatagaagagacaaagacacccccctggacccatcaatggccaccctgattctgcctaagaataaagggagaatgcagaataagaagccaggctttacagtatcatgctctccaaagagaaccataaactccagccaagagccagctccaggtatgaagccaaactggcctaggagcagatatcctgccacaaagagaggctgtgctgccatggcggcatacccatccttgcacatatacacatacccgtaggtgagcctgggctgtgccacacaagcacttcatcgggggttttgagattagacacattttataatgggggagatgtatgactgggaactgcatttacttgtggtatactgtgttgtgcactcatgcactgaccttacactttgtacttacactgtgggcatgtggtcaagatgcatacctcatgaattcaactattttttcataaaatgaaattttattatgatgtgtaaaaatgctttatcagaaactgaagtgtgttctcatggcacacttcatggcagcacagatatacctcattttaaccaatagatattctctctaaaattatgtgcaaatcaatttttaaaaatcaaaatctatgttaaacacattttggcagtgtgctataataaaaaaaagtgttgtgtcaaagctttctagtgacggtcagtcctactgctgtatgtcaggtttgctcacaatgaggtattcccacatagaaataacaatgcatgtattacccagaatttaatgttgcgtaccttatgttcaatgaggttttgtaatttttttaggctgatgattaaaattctttctctct

SEQ ID NO: 669 - DNA, 4334 bp, Homo sapiens
gtcggtgcctgcagggctctccgtggccgctcgggagaggtgctcttcgctcaggctcccccggagacttgagggggtgcgcgctggcgtgcatggggcctgttctgtccttggtttggggatgctcctaaggggggagaaagggatacctcgggtgcttggaggtcgagagacggatacgtaagtgcgcaagggccactgattagggcacgggaagggctcgctagaatgagctcttaaactggttgggtgtaagcggttttgggctagtctaaaccaaacaactgagaataaacgcggggttcctgcaggttgagagagtacctgtctgcaaatgtccagtagtgatggattgccttgtaggccccagagcaatcggggaagttagcattcttgttcaagaagctgctggttcacttagagctataaaagaatgttgtgagtttggattttcttccaaacgttcaggattgaggttagggctggtggtgagggatcatgtaaagaggtttgagtggctcagccttaggtcccggtgtggaaagcttattcttttggtgtcatcacgtggccgtgggaattatttagaatgtgatctgccctcatgagaagaaaggagctctgaagccgttgcagttcttcctccctatgtggaaaatcgaatttctggaaacatcctccgtattgggagattttgcctatgtaaaggctatccttattggctagcggcactaattactttaaaagtaggatggaagtacaagtatctcaagcatcattgggtttcgagctcacttctgtggaaaagagtttaagggagtggtctagactttccagggaagttattgcctggctgtgtccctctagtcctaattttatacttaactttcccccacctccttcagcctcatctgtttcaatggtgcaactcttttcatccccttttggttaccagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagtgttgaagaccagatggagcagtcatccttgtacttttgggaccttttggaaggtagtgagaaagcagtggtaggaacgacatacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggctacttcttctccagttacttgtagctcaaatgcttgcttggttactaccgatcaggcttcttctggatctgaaacagagtttatgacctcagagactcctgaggtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagttacatgca

SEQ ID NO: 670 - DNA, 2441 bp, Homo sapiens
ccctcatgacgtcagatcgcccccgcccgccgcgcagcttccccgagcgagaccaaaacaggtggaatccgggctggagccggagctccggcggcgcgggtggcggcacgtccctccagacagtaccacaggcacctggagtaccggcatcggtcgctgtggcccccgagtgtccgtcagagcctaggggagcctgccctcccgcgcctcgtcggggcccggccaggcaccttggccgccggcgcacggacgcgggcacgagcactagatcacggctgctggacctcggcacgttgacaagatttctctggggtaccgcggaggattactttgaatttcggtggtcgcctgtggtctggcatatttagaacttaagtctattatttcgggcaccatgactttgaggcttttagaagactggtgcagggggatggacatgaaccctcggaaagcgctattgattgccggcatctcccagagctgcagtgtggcagaaatcgaggaggctctgcaggctggtttagctcccttgggggagtacagactgcttggaaggatgttcaggagggatgagaacaggaaagtagccttagtagggcttactgcggagactagtcacgccctggtccctaaggagataccgggaaaagggggtatctggagagtgatctttaagccccctgacccagataatacatttttaagcagattaaatgaatttttagcgggagagggcatgacagtgggtgagttgagcagagctcttggacatgaaaatggctccttagacccagagcagggcatgatcccggaaatgtgggcccctatgttggcacaggcattagaggctcttcagcctgccctgcaatgcttgaagtataaaaagctgagagtgttctcgggcagggagtctccagaaccaggagaagaagaatttggacgctggatgtttcatactactcagatgataaaggcgtggcaggtgccagatgtagagaagagaaggcgattgctagagagccttcgaggcccagcacttgatgttattcgtgtcctcaagataaacaatcctttaattactgtcgatgaatgtctgcaggctcttgaggaggtatttggggttacagataatcctagggagttgcaggtcaaatatctaaccacttaccagaaggatgaggaaaagttgtcggcttatgtactaaggctggagcctttgttacagaagctggtacagagaggagcaattgagagagatgctgtgaatcaggcccgcctagaccaagtcattgctggggcagtccacaaaacaattcgcagagagcttaatctgccagaggatggcccagcccctggtttcttgcagttattggtactaataaaggattatgaggcagctgaggaggaggaggcccttctccaggcaatattggaaggtaatttcacctgagtctcagggaaccacgaagggatatggcaatgagtagagcatgaaggtagaacagtctatatactcttgtgacacatacaatccctaccttgtgctgccaagtaactcatttttgtgcaattctcagtataagccctttgtcgtttctgtgcctatttaaagtctcctaaaggtgtaattgactaggaaggatgtagttctacactgccatttacctatttaaattcatccttgtgaatatctttgttgttgttgttgagacagagtctcgctctgtcacccaggctggagtgcagtggcgtgatcttggctcactgcatcctccgccttccaggtttaagctattctcctgcctcagttgcccgagtagctgggactacaggcatgtgccaccacgcccagctaagttttgcattatcagtagagacggggtttcaccatgttggccaggctagtttcgaactcctgacctcaagtgatccacctgcttcggcctctgaaagtgctgggattacaggcgtgagacactgcgcccagcctcatccctgtgaatttcttattgtacacaagttctttcactatctgtgtgcagtgctctgaggggacagacaaggcttgggtgtatatgccaaccagatctcattgaagtatcagcttgtttggtactaggtgcaagtgtagcatgtcacatgtgaccatgttggatcattgacaatttttaggtatgtactgacctacatttatgatgaagatcctgagcggaggttaagatattaagttattttccatatgaatcagaattatattgattctgtgcaatcaaaacaaaaggcagaatagaatgctgagattggttaagtttgcaatgaccatcttgaaccacagatttctgctatgtgtcatcaaaacatctagttctgagtaacattttcacgattgttataaaattataggtgtgaacttctaaaataaaggaatgctaataaaatga

SEQ ID NO: 671 - DNA, 3199 bp, Homo sapiens
gtgctcgcgccaacccctacgccccagcgcgccttctccacccacgcacgggcctcggacgcatttccagccccggcgttggttgtggatgctggacatccaccgcctccaggcagtttcgccgtcacaccgtcgccatctgtagccaaagcaaaacatatcctaactgagactttgcagctcttgtggccactctgggctcaccgggaacatgagtggaagagcccgagtgaaggccagaggcatcgcccgcagccccagtgccacagaagtggggcgcatccaagcctcgccattgcctagatctgttgatcttagtaacaatgaagcatcctctagcaatggcttcttgggaacaagcaggatctcaaccaacgataaatatgggatatcttctggtgatgctggaagtaccttcatggaaagaggtgtgaaaaacaaacaggactttatggatttgagtatctgtaccagagaaaaattggcacatgtgagaaattgtaaaacaggttccagtggaatacctgtgaaactggttacaaacctctttaacttagattttccccaagactggcagctataccagtaccatgtgacatatattccagatttagcatctagaaggctgagaattgctttactttatagtcatagtgaactttccaacaaagcaaaagcattcgacggtgccatcctttttctgtcacaaaagctagaagaaaaggtcacagagttgtcaagtgaaactcaaagaggtgagactataaagatgactatcaccctgaagagggagctgccatcaagttctcccgtgtgcatccaggtcttcaatatcatcttcagaaagatcctcaaaaagttgtccatgtaccaaattggacggaacttctataatccttcagagccaatggaaattccccagcacaaattatccctttggcctgggtttgccatttctgtgtcatattttgaaaggaagctcctgtttagtgctgatgtgagttacaaagtcctccggaatgagacggttctggaattcatgactgctctctgtcaaagaactggcttgtcctgtttcacccagacgtgtgagaagcagctaatagggctcattgtccttacaagatacaataacagaacctactccattgatgacattgactggtcagtgaagcccacacacacctttcagaagcgggatggcaccgagatcacctatgtggattactacaagcagcagtatgatattactgtatcggacctgaatcagcccatgcttgttagtctgttaaagaagaagagaaatgacaacagtgaggctcagctcgcccacctgatacctgagctctgctttctaacagggctgactgaccaggcaacatctgatttccagctgatgaaggctgtggctgaaaagacacgtctcagtccttcaggccggcagcagcgcctggccaggcttgtggacaacatccagaggaataccaatgctcgctttgaactagagacctggggactgcattttggaagccagatatctctgactggccggattgtgccttcagaaaaaatattaatgcaagaccacatatgtcaacctgtgtctgctgctgactggtccaaggatattcgaacttgcaagattttaaatgcacagtctttgaatacctggttgattttatgtagcgacagaactgaatatgttgccgagagctttctgaactgcttgagaagagttgcaggttccatgggatttaatgtggactaccccaaaatcataaaagtacaagaaaatccagctgcatttgttagagctatacagcaatatgttgatcctgatgttcagctggtaatgtgcattctgccttctaatcagaagacctattatgattccattaaaaaatatttgagctcagactgcccagtcccaagccaatgtgtgcttgctcggaccttgaataaacagggcatgatgatgagtatcgccaccaagatcgctatgcagatgacttgcaagctcggaggcgagctgtgggctgtggaaatacctttaaagtccctgatggtggtcggtattgatgtctgtaaagatgcactcagcaaggacgtgatggttgttggatgcgtggccagtgttaaccccagaatcaccaggtggttttcccgctgtatccttcagagaacaatgactgatgttgcagattgcttgaaagttttcatgactggagcactcaacaaatggtacaagtacaatcatgatttgccagcacggataattgtgtaccgtgctggtgtaggggatggtcagctgaaaacacttattgaatatgaagtcccacagctgctgagcagtgtggcagaatccagctcaaataccagctcaagactgtcggtgattgtggtcaggaagaagtgcatgccacgattctttaccgaaatgaaccgcactgtacagaaccccccacttggcactgttgtggattcagaagcaacacgtaacgaatggtatgacttttatctgatcagccaggtggcctgccggggaactgttagtcctacctactataatgtcatctatgatgacaacggcttgaagcccgaccatatgcagagacttacattcaaattgtgccacctgtactacaactggccgggcatagtcagtgtcccagcaccatgtcagtatgctcacaagctgacctttctggtggcacaaagcattcataaagaacccagtctggaattagccaaccatctcttctacctgtgatggcatgaactactggcatcactagatggacaatccaagaagaaattggtatactttgtgcaaatctgccataagctcaaggctgtgactggggaaaaagattgagcttagttttcatgtctaggaaaaaaagcaaaacaacttaatctgaaacagttttaaaaaatgtgtgttattttgttttaaagagttgtatgcttggggtaaattttcattgtcatatgtggaatttaaatataccatcatctacaaagaattccacagagttaaatatcttaagttaaacacttaaaataagtgtttgcgtgatattttgatgacagataaacagagtctaattcccaccccaaattttgctgaggttttcttaatgttgtagagcattttgtagagtggtttaaatagttgaaaataaagttcagaacatca

SEQ ID NO: 672 - DNA, 8628 bp, Homo sapiens
gtgctgtggcggcggcggcggcggtagtggcggcggcggcggtgcctgggcggcagcagcagcagtagcggcagccctgaggacggtgagacggccgcggcggcggcgacagcgcggaagtcgcgcgggacccagagcttcccccctgtcgctagtgctgaggctttcgcctttcctacccagcttcttgctcacggcccgggctgggctgggcagggcaacgcgcccccggggaggggcggagctgtagatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagccttttttctaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtcactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcaggaggcaggagaatcgcttgagcctgggaggcagaggctgcggtgagccgagatcgtgtcactgcactccagcctgggtgacagagactccatttaaaaaaaaaaaaaaaaaatatatatatatatatatatatatatatatggatgggaatcaccaaattcatctcagctctaaccttttaacctttgtccttgcactttacaatctaaagatctacctgtggctctcagacttcctcacacttgggttttagaaataacttgtaaagcagactggacccaaggccgccttcagtgtcaagaagggcattgtgacttgcccctcaatttctgtccattgaagtctggttttccatgaggaacttgcgggctcacccacccccagagtgagagaagaggaaggcgaagtcatcacagacacggtcttagccacctgctgaactaatccctccgctattgagggtcagggttgtgaggcaaccatcatgtgtcaccccaaaatataaatgtttctgagccgcccatccactggcatttggatttgctgccagagtcctgttcctcccagaaccatcccgccctcctgttgaccatgttacttgagtgtaggcccggtgtcaagaccctcagagtctttgaggaaagagccaagcagagaagaccgctgcgtggagtgtgacaccacatggcatttctcaagcccagcggaccctgtgtcagcaaataccagtaatttaacatctgctcctggcctcctcttcacctgcctgggttcggaactgaggaggaaggatgagaagagactgcaatgcagcaggcaccctctgcagagtgaggccgcccgtccatcactgccagccctgggctgctcaggaggggacgtgaaccactcaaaggaatgtcttaaagaggatctggagtttcccccatgcaaattagggaagaattaggcaagaaaagacatacattacagggaaatccttctgaacaaaatggctgtcttcacctactcttcttgcaagaaaagacatacattacagggaaatccttctgaacaaaatggctatcttcacctactcttcagcaaaaaccgtctccagactttttagtgtcaaaaatgtaaccaactgtctcctgattttttccaatgtgtttggcaagtgctgtggccctgttgtaggtacttctcctgactcttgggggagaagtggttttagggattgatttgggggagcgggtttttgtcccatcccacctcctctcttctttctctgcttgtcgatattgtctgtgtgattcagagaattggggcagttacattgtgtctgttgttgagattattaaaagattaaaacgtagttgtagaaatgaaaaattaaacagctgtgttttaaaaatgcaaaccaatatcttgttaataaaggaattcaagctatggggcagccacactcccctcctcccaggctggcataggtggccctgggctggcggcttaggaagcatggagcacacttagggtagtgcctgcctgggcaagagacacctgccgagcaaaaggaacgagaatctggggctcagagcctcgcagttgtgccaggattttcctatacatgttcaggacctctgggtagaggtttcacagtttgtgaccccataaccaccctcacccgacgtgggttctagctcagtgtgcctaatactgcatggtaacctgggcttgaccctgaagcccctgcctggcaggccacaggacctctcctgcccacttggtgctatctcttccagtgaccacccagcacgggtgagcactggccagcctggagcctgcaatccaggtggaacagactgtcctccatgtcagttccttctggcttcaggccctcaattatttccctttgagcttttttagaccctagatctcctaggcccaggctctctcttgaccccagagaagccactgtcaggaaaggaagtgaaccctactgaagccagagaattcaccccggccaaagcaggccctctgggtccagcccctcattccacaccacgccagtattgcatccatctactgcagctacacatcctgagggcagcaccacccactctggcctgctggcccatcgcaggactagcccaggcacctgccgggcattgcaggatatccagtggggcctgtgactgctccctgatgcgtcagaagagaagtgttgcactttagtggaggagctgaggagcacctgcccccttgtagcttgagttccttttggtaacagtagcagcctccatggtggtgtctgggatgcacgtgcacccgctgccttcagctgtatgtgtgtgttcctgctggagttgtgttactgacaggataatgacattacaaagaaattgtgttatattcaactttgccttgataattattgtaaacactttgttcattttttcttttttattcacaaactaaatccaccaggaaattataaagttattt

SEQ ID NO: 673 - DNA, 4848 bp, Homo sapiens
cggtcactccaggctgcctcgctgcgccgctggcggtgggcgtggcgctgccggcggctaggcgcggacgccggaggaggtgtccccgggtttaggggtgttcggccaggggcggggctgccgggcccgggcgactgccggagctgcggaagtcgtggaagcgtcggcgacgcatcgcgcgatggcgcgggcgggacagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggcctgattggtcctacccagcttaacggggtggggtttttttgtttgttcagacagtctgttcttttgtaaacatttttagttggaaaaacagcatctgcattttccccatcctctacgttttagagaggaatcttgtttttgtgtgcaacataagaaaattatgaaaactaatagccaaaaaacctttgagattgcattaaagagaagggataaaggaccagcaataataccttgtaagttgcttttgtttgtaaaatctgagcttatagttttccttagtgagtaaattcataaggatgggaacatttaaattaagttaatgggcctttaaaaaaaaaaaaaggaaacactcatacctgtagttggaggatgaatactggagacgggttaccaatgtcaggttatactaaaactaaatcagaaagtctgaatgtagcacataatggttctcttctgttgtccaaggctgtaaaatggacagccttgtcacacctccccggtgctgttttacaacgtgagggtagacgctgtcagtaacccagagggaccaggccttcctaggttttctaggcagtcagctgttaaccactcacttagtaaatgtcataactacacctgctccaggaccaatcagtgaaacctgctcggaattaaaggcttcctctgggtgcctgctgaacaactgagctcatgtcatgggcatgtggtggtttctctgttgcctgaaagagccattaaagtcagtcgtgcgtgaagcatctctcttctaaaggatgtgtatttccataaatgctttctgaggatccggtacaaaatgatttcccaaagttctgaagtgccttgagaacatgtgggtccgagtgttataacagactcctcccccgggtcaccttttgcctggtcatcctgttagagtacatctttggaaatccagggtaatattctctttcagagatgctcattgtgtaactctgtgtagggagatagtcactttaaacagctcaaagtagctagctaaaggagtagccttaaatacctaaaagatgacagaagcatagcccttaacaaatcttcagcttgtctctcagtatttcccaatcatgaaaatcccttgctatgtctttcctactagaaatgttctagaatcgctggacggtggggtcagagggcagtcggtatttaggccgtgagcttcccatactactgcaggtccaactcctggcaaccgcgggctcaaggcaggtcattggaatccacgttttggccacagtagttgtaggattgcttttctgtatcataattttagaatgctcttaaaatcttgaggaagagtttttattttttatttatttttgagatggagtctctgttgcccaggctgcagtgcagtggtgccatctcagctcactgcaacctccacctcccaggttcaagcgattctcctgcctcagccacctgagtagctgggagtacaggcatgtggcaccatgcctggctaatttttgtatttttaatagagttgagatttcaccatgatggtcaggctggtctcgaactcctgacctcgtgatccgcccgcctcggccccccaaagtgctgggattaacgggtgtgagccacggcgcccagcccaggaagagtttttaaattagagctctgtttaattataccactgggaaatcatggttacgcttcaggcatattcttccccagagtactacttacattttaaatttcattttgtaaagttaaatgtcagcattccctttaaaagtgtccattgttctttgaaagtagacgtttcagtcattcttttcaaacaagtgtttgtgtaccttttgccaagctgtgggcatcgtgtgtgagtacagggtgctcagctcttccaccgtcattttgaattgttcacatgggtaattggtcatggaaatgatcagattgaccttgattgactgtcaggcatggctttgtttctggtttcaatctgttctcgttccttgtaccggattattctactcctgcaatgaaccctgttgacaccggatttagctcttgtcggccttcgtggggagctgtttgtgttaatatgagctactgcatgtaattcttaaactgggcttgtcacattgtattgtatttttgtgatctgtaatgaaaagaatctgtactgcaagtaaaacctactccccaaaaatgtgtggctttgggtctgcattaaacgctgtagtccatgttcatgccaaaaatggctgggaacgtttgctttatttacattcagtcagcgttgctttcagatcacactttatccacacaggaaagccagtcagcctataatgaagtagttattaaaataaatgtaatgaatatgtctacaaagtatagtttagtggtttattttgctaaaatgcacatatatttgatataatttagtttgagaagttcagctagtttttctcctttgtttgactttgtcaatttctatctggtttttaagggtctgagcttagcttgtgcatgcaaggttttgggtttttttattttttttttgagcacagcttttcaccttttaatttgttgggtatttttctcttaataagagaaatattggccatcgatttttacatataatacaagtgtgtttttccagtacattggttcctgtcccctctctgtgaactgtttgagtattggaacagtatgtcttcaataattcaatgttactttgagatacatgtgttaatatacccttagttattcttgaaataaaaccagtctcttacgcttgcagtggagaaaggc

SEQ ID NO: 674 - DNA, 4469 bp, Homo sapiens
gcagtcgctgccgaccggctggctgggccttgcggcgtgaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacagtggcaccactgcaagtggaggtgagaacgagcgtgaggacctggagcaggagtggaagcccccggatgaggagttgatcaagaaactggtggatcagatcgaattctacttttctgatgaaaacctggagaaggacgcctttttgctaaaacacgtgaggaggaacaagctgggatatgtgagcgttaagctactcacatccttcaaaaaggtgaaacatcttacacgggactggagaaccacagcacatgctttgaagtattcagtggtccttgagttgaatgaggaccaccggaaggtgaggaggaccacccccgtcccactgttccccaacgagaacctccccagcaagatgctcctggtctatgatctctacttgtctcctaagctgtgggctctggccaccccccagaagaatggaagggtgcaagagaaggtgatggaacacctgctcaagctttttgggacttttggagtcatctcatcagtgcggatcctcaaacctgggagagagctgccccctgacatccggaggatcagcagccgctacagccaagtggggacccaggagtgcgccatcgtggagttcgaggaggtggaagcagccatcaaagcccatgagttcatgatcacagaatctcagggcaaagagaacatgaaagctgtcctgattggtatgaagccacccaaaaagaaacctgccaaagacaaaaatcatgacgaggagcccactgcgagcatccacctgaacaagtccctgaacaagagagtcgaggagcttcagtacatgggtgatgagtcttctgccaacagctcctctgaccccgagagcaaccccacatcccctatggcgggccgacggcacgcggccaccaacaagctcagcccgtctggccaccagaatctctttctgagtccaaatgcctccccgtgcacaagtccttggagcagccccttggcccaacgcaaaggcgtttccagaaagtccccactggcggaggaaggtagactgaactgcagcaccagccctgagatcttccgcaagtgtatggattattcctctgacagcagcgtcactccctctggcagcccctgggtccggaggcgtcgccaagccgagatggggacccaggagaaaagccccggtacgagtcccctgctctcccggaagatgcagactgcagatgggctacccgtaggggtgctgaggttgcccaggggtcctgacaacaccagaggatttcatggccatgagaggagcagggcctgtgtataaataccttctatttttaatacaagctccactgaaaaccaccttcgttttcaaggttctgacaaacacctggcatgacagaatggaattcgttcccctttgagagattttttattcatgtagacctcttaatttatctatctgtaatatacataaatcggtacgccatggtttgaagaccaccttctagttcaggactcctgttcttcccagcatggccactattttgatgatggctgatgtgtgtgagtgtgatggccctgaagggctgtaggacggaggttccctgggggaagtctgttctttggtatggaatttttctctcttctttggtatggaatttttcccttcagtgactgagctgtcctcgataggccatgcaagggcttcctgagagttcaggaaagttctcttgtgcaacagcaagtagctaagcctatagcatggtgtcttgtaggaccaaatcgatgttacctgtcaagtaaataaataataaaacacccaactgggagtgctgactttgaggttatagattgtgcctgacaaaagtctgtgcctgtctgacagagctgtgggtggtatgtcatgaggccctgaggagcttagcagagacatctttcttttctttaagagaacatttaaaaatttttttatttgtacacatttatgggctacatgagaaactttgttacatgtttataatgcatagtgatcaagtcagggcatttagggtttctcactgtaccccagggcagccccagggctctccttgggcttctggcagcctgagtggtgtctcatcacagggaattttactgagcaaaggcagcttggcgtatactgagggtgtacagtccaggacccacagcattgatctcacctgggaacttattagaaatccagattctcaggccaaccctaggcccactgaattagaaagtctgggagaaaggcctggaatttgggttttaacaaacgctgcaggtgattctgatgcacgctggagaaccactggatggacaaaggctgcaggacttgaggtcagtccatttgacccccaatctctcactattttgtgaccttgggaaggttactaagccccgtgaacctcatcatctccctgtgaattgctttgttacgatgtccatgtctggaatgcagctggccctccataaatgttagctctctttccttctcacttgggttaatgtttgttatcatcaggagctgccttggtgtagcagaaagagcattggcctagattccagtgttggcttatgctctggctatttggcaggatttaatagagcttgttaataattattgaacagtgattaggtgccagggactatgctaagagctttccatgcattatctcatttaatctgcccaaaaactacaagagaaatgttcaggtattatctctattttattccagaaaaaaacagactttacttgggtaattaacttgtctaaggcttaacagctaaattggtagagttgggcttgaaactagtggtctggctttggagcccacactgtttaaccactaagtggtactcaacatttctgatctttactatccatattcaaaaaagaatccaccataaaaggtgctaatatttattcagcaccttcctacgtgctaggcattgggttagacacatttcacttactctcagtgtccatcataaggaattattatgccagtatcacacatgcagctgctgaagtaggaaaataatatcccaaacttgtgaaaatggacaaagatagtatatcctaaatgatatggctctatacaaattagcaggtgattgtgatctggatagtaagatgctttgtcccttaagatgcagaagagttcgtgttaactggcaaatgcctccagcaatgttctggatttgccatttccagcactaccagctgtaggtagcctgaaggcttgtgcctagaccaccaggactcctgaccttgggcaatgtcagggccccctccagccccgccctatgcttccctccctgactctgctcccatcaccccctgcctgctccttccctgcagccactccacctgctccttggccatcgggccatctgggcttcaccagctcttcttggcctgtgacattcaaggctgttccaccctattatgcctgttacacaagtcacagctctatttttagattaaccctcgtggatcatagttacttttaaaaatacctacaccctcacctttacatgtgaatacagatgaacttggccttcctttggtcgtattgccctgtgtgacattataaaagaaccctgaagtgggggtcagcagatctgaggtcgagtcgtggcttttctactaagcaactgtgaccttcagcaagtcatttattttattggttcacagttcttcccacaaaccagtggataacaagaagatgttccttaaataaggtcatatatgtgcaagtgctttctgaatggaaaagtgctttgcaggcattagtcactacttatcctgctgtctgatcatcacctccaaaggcaagcctccttttgctgcaattcttaaccctggcctcacattagagtcacctaaagagcttttaaaaactgcctatggggctgggcacggtggctcacgcctgtaatcccagcacttcaggagactgaggcgggcagatcatgaggtcaggagattgagactatcctggctaatgtggtaaaaccctgtctctactaaaaatacaaaaaaattagccgggcatggtggcacgcacctgtaatcccagctacttgggaggcggaggcaggagaattgcttgaacctgggaggcggaggttgcagtgagccgagatcacgccgctgcattccagcctgggcaacagaatgagactccatctcaaaaaaataaaaataaaaataaacaaa

SEQ ID NO: 675 - DNA, 1006 bp, Homo sapiens
cggggtgggattccaacccagaagcgggcatttggagccctcatgcttcaccctagctccctgaaacaagcacggaggatggctctgagcagcgaggaaagtgctggaagcaagcaggccgagcgcgtccctggctggggacgttaatcattaccggagggcggcccgagcgcggccccgccccgggacggcagcctgcgcgcccggccgccgcctgccctctccgctggccacctgctgccgcccgcgccatggctggcaaagcacacaggctgagcgctgaggagagggaccagctgctgccaaacctgagggctgtggggtggaatgagctggaaggccgtgatgccatcttcaagcagtttcatttcaaagacttcaacagggcctttgggttcatgacaagagtggccctgcaggctgagaaactggaccaccatcctgaatggtttaacgtgtacaacaaggtccacatcacgctgagcacccatgagtgtgccggcctttcagaacgggacataaacctggccagcttcatcgaacaagtagcagtgtccatgacatagaccctgcccttcctctttgaattcttccgggggaaggggtgactgaactgggagtccagggagggagctgaggagcccttaccctcccaccactcccctcccaagacccagccgccgccgttgagggctgagtccttgctgtgggatgtgccagtgtccccaccaacaccaggaatttagaccttttccctgcaccactctcttcatcctgggggctctgttacactaatttgaataaactctcccctttctttgcaacttcccagcaacaataatgattttcttgccaggccgtctcttgctccctaattcatttcccaggaagctgtgatacagggtgaaataaagtcttgtcttagaaaccaggaccctaaaccccacactatgtaatagaaacacatgtgtttttatgtctcaaataaaactattatatcacttgg

SEQ ID NO: 676 - DNA, 1176 bp, Homo sapiens
aggtggcagcgcttgcagtcgggctacggaggccgggttgccagattacgggaaagccatttaagaagttcctggaataatattagtcagagtaatataggatctgcaggaagtgtctcaagatagttggaaaagaagaatttctagactcttcatcaagatcttcatttatacagctgttaaatccaaggctactttggtgaaagcatgaataaaaatacatctactgtagtatcacccagtctacttgaaaaggatcctgcctttcagatgattacaattgccaaggaaacaggccttggcctgaaggtactaggaggaattaaccggaatgaaggcccattggtatatattcaggaaattattcctggaggagactgttataaggatggtcgtttgaagccaggagatcaacttgtctcagtcaacaaggaatctatgattggtgtatcatttgaagaagcaaaaagcataattaccggagccaagttgagtactaggttagaatctgcttgggagatagcattcataagacaaaaatccgacaacattcagccagaaaatctgtcatgtacatcacttatagaagcttcaggagaatatggacctcaagcctcaacattaagtcttttttcttctcctcctgaaatactaatcccaaagacctcatccactcccaaaacaaataatgacattttatcttcttgtgagataaaaactggatacaacaaaacagtacagattccaattacttcagaaaacagtactgtgggtttgtctaatacagatgttgcttctgcctggactgaaaattatgggctacaagaaaagatctccctaaatccctctgttcgctttaaggcagagaaactggaaatggctctaaattatcttggtattcagcccacaaaggaacaacaccaagccctgagacagcaagtacaagcagactcaaaagggacagtgtcttttggagattttgtccaggttgccagaaacttgttttgcttgcagttggatgaagtaaatgttggtgcacatgaaatttccaatatattagattcacagcttcttccttgtgattcttcagaagcagatgaaatggaaaggctcaagtgtgaaagagatgatgccttgaaagaagtaaatacacttaagtggccagggcagaattag

SEQ ID NO: 677 - DNA, 1660 bp, Homo sapiens
cggcggatgtttacggcggccgaggttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttacggtctccctcttttgtccaaggctggagtgtggtagtgctatcacagctgactgcagcctcaaccttccaggctgaagcgatcctcccatctcaatctcctacgtggctgacactacaggtgcttgccactatgcccaactaacatttggaattttcgtatacgtggattctagaggggtgacagcgaaacctgcaggacaaattcgagcatcttaaaatgattcaacaggaggagataaggaagctcgaggaagagaaaaaacaactggaaggagaaatcatagatttttataaaatgaaagctgcctctgaagcactgcagactcagctgagcactgatacaaagaaagacaaacatcgtaagaagcaatagtttctcttactattctgagagccttatcattctacatcccatcttcctgtgagattgtctttgtagcatttaactctaattgcagttctctttttaaaaattggcttgcttattgtatattttccccaactaaagcgtgaactcctagcagggcgtggtggctcatgcctgtaatctcagcactgtgggaggccgaggtgggtcgactacctgaggtcaggagttcgagaccagcctgaccaagatgatgaaacgctatctctactaaaaatacaaaaattagctaggcgtggtggctgggacctgtaatcccagctacttgggaggctgaggcaggagaatcacttgaaccctggaggtggaggttgcagtgagccgagatctcaccattacactccagcctgggtgacaagagcaaaactccatctc

SEQ ID NO: 678 - DNA, 1973 bp, Homo sapiens
agccgccgcctcgccgcttcccctcgtcggagcggccgctcgtccgcccggcttgaggcccgcggggagcgcggcgcaattcgtcggcccgcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgtagttgaaaagtttactgtaaaaaaatcaaaaacaaaaaaatgtattgtttttacagaataaatttattggaatgtgtactgggagtaagatttgaggttgtaagcaaactaagttagtgtaatttggcttcatatatgtaacgtgaggtattaatgtaattcatatattaaagcaaaaattgttcacagc

SEQ ID NO: 679 - DNA, 1020 bp, Homo sapiens
cctggttgctgggtgcaaagtgctgggttctgggtttctggattcgcgggccgttcacacgtagcctgtgccggctcctcgggtgagtccgtccgcgcgcggtgccccgggacggcctaggctgccgggggtccggggccccaggcattccgggctgcagattgacggggatcccggatgcaccgcgcgcccccgcgccctcaccgacgggtccagacctggtgggaagaaggtgcggggacgggtccctgaggatcccgatgcctacgagccaagatgctcagctttataggtgtgacctacacatgtgacttcacctcagttttgtgatccgtaaaatggacaaattcgaagctacttcacagtgctgttgagaggattaaatgaaacaatgcttgtaaagctctttgcaggagggagcctcggaagcagggcctggccggcagagcacacctgctgtcaccagggaccacaggcagcatgaagacccccgtggagctggccgtcagtgggatgcagaccctcggccttcagcaccgctgccgaggtggctaccgggtcaaggccaggacgtcatatgtggatgagactctgtttggcagcccagcaggcacccggcctaccccaccggacttcgatccgccctgggtggagaaggctaacagaaccagaggcgtgggcaaggaggcatcgaaggccttgggggcaaaggggagctgtgagaccaccccctcaaggggcagcacccccaccctcacaccaaggaagaagaacaaatacagacccatcagccacaccccgtcttactgtgatgagtcgctgtttggctcccgatctgaaggcgccagcttcggggccccgcggatggcgaagggggatgccgcaaagctccgtgctctcttgtggacgccaccacctacccccaggggtagccactcgccccgccccagggaggcaccaccaccagtgccccccacacaaatgggcctcaggatctcaggccttccacgtcaggggtga

SEQ ID NO: 680 - DNA, 1301 bp, Homo sapiens
agaatggcctcggacacccaggcagtccctgacgtgtcggggaggagccgggcgcggaggtacgctgagtggagctcggggctgcgtaggggagctgagccgagcggctgggcgggcctggccgggccggcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaaggctcctcctccagctgtgcgatccgagcttccagacgccgcttctcatccagcagcgcggacctggcggggagaggaggaggggacggttcaatcccagctcagcacagcacaggagcctcagggaaggctcctccacccaccctgttgctggaaacctga

SEQ ID NO: 681 - DNA, 2382 bp, Homo sapiens
caggtctcccaggcttcctcagcgtcgacgccggggagcgccctggggttgggagcgcccggggcccgcgaaggaggaggtggctcaggtgtcagggcgcaccgtgggaaccggccccgggggaggcgtggaaacgcggggcctgggactcgaccagcctctcccgtgcggatcgcaaaatctcggagctgaaacagcccgttgttcgcagcctccctctgacccgccaccctgcacattgttttccattcgcccgggtcgcgggtgggaggagaggcacgccggggttctggagcttggccgcgcgccaggcttgtggccttcgtccccctggggccactggggcggccacgcctctccggcgggaggagagaacgcgtgggtccgggtggctgctccggcccttccgcctccagctcggccatggggtcgcgcagctcccacgccgcggtcattcccgacggggacagtattcggcgagagaccggcttctcccaagccagcctgctccgcctgcaccaccggttccgggcactggacaggaataagaagggctacctgagccgcatggatctccagcagataggggcgctcgccgtgaaccccctgggagaccgaattatagaaagcttcttccccgatgggagccagcgagtggatttcccaggctttgtcagggtcttggctcattttcgccctgtagaagatgaggacacagaaacccaagaccccaagaaacctgaacctctcaacagcagaaggaacaaacttcactatgcatttcagctctatgacctggatcgcgatgggaagatctccaggcatgagatgctgcaggttctccgtctgatggttggggtacaggtgacagaagagcagctggagaacatcgctgaccgcacggtgcaggaggctgatgaagatggggatggggctgtgtccttcgtggagttcaccaagtccttagagaagatggacgttgagcaaaaaatgagcatccggatcctgaagtgactccgtttgtgccttgggcttgctcctgcaaccagtatctccttggaattcatccaaagcccccatggacgcatggacgcagggcgacaataaactgtattttcgtttctaactctatttagggccaagagaagaaagctggaaggatgtgtactaaagtctagctcagcagtccccaacctttttggcatcagggacagtttttccacggatgggtgacaggggatggttttgggatgattcaagtgcattacatttattgtgcactttatttctattatgattacattgtaatatataatgaaataattatacaactcaccataatgtagaatcagcaggagccctgagcttgttttcctgcaattagacggtcccatatgggagtgatgggagacagtgacagatcatcaggcattagattctcataaggagtgcacaatctagatcctttggtgtgcagttcacagtaggatttgggctcctatgataatctaatgccactgctgatctgacaggaggcagagctcaggcggtaatgcaagcaatggggagtggctgtaaatatagatgaagcttcagctcgcctgccgctcaccttgtgctgtgcagcccggttcctaacagaccacagaccccacaccaggtctatctcatttggtctcagagctgtgaatcagccagcaatattttagttgcaaatcactgaaaacccaactcaaagtgacttaagtcagaaagaaattttatgaattcaggtaattaaaaagtccagaagtatctgcctttaggcacagctggatccaagggcacaaatgatgtcatcaggctccagttattctccatctcccagctcagctttttctgtctgtaagcctgattttcaggaaggctctttcctagtgatggagatgaccaccatcagctccaggcttctatcctgctaacccagtaacccagtgggaagagatttacttattccaataattccaagtggagagtgtcattgacccgtttggggtctcatctctacttctaggggaatgaaacactctgagtggccaggcctgtgtcatgtgctaattcctagagccagggaaataaggtctgaggattcaggatggggtgaaaggtggttgcttaaaggaaaatgaaatacaattagcagaataaggggaaacgagtggtctgctctgctcgggcaaaacaagagatgcccattactgtgagggacccttgaagtctggactcttaaatgggtttttgctgatttcctgggtgcatgctaggatgatggggcttgatgcagtagggaagagacgatgtaaaaataataaacaatatataccttcctagagtgtgaatgca

SEQ ID NO: 682 - DNA, 4072 bp, Homo sapiens
acccgcgcgcggaggagccggggagtcagcgcttcttccctccctccccctctcccctccccgctccctgcccccctccccaagaatgttccgctacgagtctttggaggattgtcctctggatgaagatgaagatgcatttcagggactgggagaagaagatgaagagattgatcaattcaatgatgatacatttgggtcaggtgcagttgatgatgattggcaggaagcacatgagcgcctggctgaattggaagaaaagctaccagtggcagttaatgaacaaacaggcaatggagagagagatgaaatggacttgttgggtgaccatgaggagaatctggcagaaaggctcagtaagatggtgattgaaaatgaactagaagatccagctattatgagggcagtgcagaccaggccagttttacaaccccaaccaggaagtctgaattccagtatctgggatggatctgaagttctgaggcgaatccgaggaccactgcttgctcaggaaatgcctacagtgtctgtattagaatatgctttgcctcagaggcccccccagggtccagaagatgatcgggacctttctgaacgagcattaccaaggcggtcaacttcacctatcattggcagtcctcctgttagagctgtccccataggcaccccacctaaacagatggctgtacccagcttcacccaacagattctgtgtccgaagcctgtccatgttcggcccccaatgccacctcgttatcctgctccctatggtgagaggatgtctccaaaccagctctgcagtgtcccgaactcttccctcctgggtcacccttttcctcctagtgttcctcctgttctcagccccctccagagagcacagcttcttggaggagcacagctacagcctggacggatgtctcccagccagtttgcacgggtccctggatttgttggtagtccacttgctgccatgaatcccaagttgctacaagggcgagttgggcagatgcttcccccagcaccaggcttccgtgccttctttagtgctccaccctccgctacaccacctccacagcagcaccctcctggcccaggaccccacctgcaaaacctaagatctcaggccccaatgtttagaccggacacaactcacctccatccacagcaccgtcgactcttgcatcagagacagcaacagaatagaagtcagcatcggaatctcaatggtgcgggagatagaggaagtcaccggagcagtcatcaagatcatctccgaaaggatccatatgccaatctcatgttgcagcgggaaaaggattgggtctctaaaatccagatgatgcaactgcaaagcactgatccctacctggatgatttttattaccagaattactttgaaaaactggagaaactgtcagctgctgaagaaatacaaggtgatggccctaagaaggagcgcaccaagcttatcacccctcaggtggccaaactggagcacgcctataagccagtgcaatttgagggctctttgggaaagcttaccgtttctagtgtgaataatccccgaaaaatgattgatgctgttgtgacatctcggagtgaggatgatgagacaaaagaaaaacaagttcgagacaagaggagaaaaacccttgttataattgagaaaacctacagcttactccttgatgtggaggactatgaaagacgttatctcctaagtctggaagaagagcgacctgccctaatggatgacagaaagcacaaaatttgtagcatgtatgacaacttaagggggaaattgcctggacaagagaggcctagtgatgaccactttgtacagatcatgtgtatccgaaaagggaagagaatggttgcccgtattcttcctttcctctccacagagcaagcagctgacattctcatgacaacagccaggaacctccctttccttatcaagaaggatgcacaagatgaggtgctgccatgcttactgagtcccttctctctccttctctatcatcttccatcagtgagtatcaccagccttttgcgacagctaatgaacctacctcaaagtgcagctacaccagcactctccaatcctcacctcactgctgtgctccagaacaagtttggcctgtcactgctcctcatcctcctgagccgtggtgaagacctacagagttcagaccctgctacagaatcaacacaaaataatcagtggacggaggtgatgttcatggcaacacgagaacttctgcggattccccaagcagccctggccaagccaatctctatacctacaaacctagtgtccctcttttctcgctatgttgaccggcagaaactgaacttgctggagacaaaactgcagctagttcaggggatacgataaaagatctccaaatgtgtcctgtacctccttttggctgccacctgcactgctgccatcaccaatggagtgtttttaatgagggaaggaaggtagctttttccccaaagcaaagtcttgtgggatcgattcctgtttacaggggttgtctctctaaatgtcagatatttccccactgctctatgaaatttggctgggtgatacttctgctggtttctttaccttctgtgttacagttctgcatgtcctacttttactcagttctgttttgcattttctttgccctagagacacaagtgtaatctctccctttatccctccactactccacctcagagtagattgtagcctgccaaaggattccttccctcatcctattgaagttgttttttcattgccccatattaatatgactatagaagagccaattaagtagaaatcaagatatacacacacacatagatacacacacacacaccccatacatgtatttatgtggtcttcagagggtccttaaagaatgaattttagattgaaaaatatttagttgtctcattacctcttctaaacacaaaccagctgatgtattttaatctgtttctgttctatcttgtaattaatttggtgggttctacttgttttaacataaataaagagtatgcagcacgtttaataaaatcagaactcttaattggcttatgcccaggtctaggctgagaagtcctttttcttcttcccacctttatttccttagtttctgtccaccttaatcgaaacaacacatggttatgtctttttcctgctacaactacagggtacttgagcctttcccctcaagtgcattcgaagtcacccaggatgatcctcactagtagcctgctttggcagtgtggctttttgcacacttgccctgtcttcctgagactacttcagtaagccatgcttccttcttccccacttttatttggtgtcatgaatagaaacttccaaatgtaaccatggaagctaagtttggcctgctttgctttttagtctccacaccatgggcagaactgctgtctttactacttcatctcacccaagtcccgttcccaggcagccaggggcctgggtttgaataattgcagggccagcctgccatgatctttctcacttactcctctcccattcagcaatcaaccagactaaggagttttgatccctagtgattacagccctgaagaaaattaaatctgaattaattttacatggccttcgtgatctttctgctgttcttactttttcgaatgtagttggggggtgggagggacaggttatggtatttaaagagaataaacattttgcacatacatgtattgtacaacagtaagatcctctgttaaaaccagctgtcctgttctccatctccatttcttcccatgctgtaaccccaggctccaccagctgttccccagtgatgttacctagcttccctctaccgttgtctactgaccatttccactacatgcctttcctaccttcccttcacaaccaatcaagtgaatacttgattattatctcttccttactgtgctttatcttttttgtttggattggttctaattaatgaaaataaaagtttctaaatttacatttttatagggtattgtaaataaaaacaaattgtatacttaaaaa

SEQ ID NO: 683 - DNA, 3727 bp, Homo sapiens
gccgggtttgggggttgggacctccggctgcaggtccgcctgggccagacgcgcgagcgcaagcagcgggttagtggtcgcgcgcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgacgtgctagaactcacggacgacaacttcgagagtcgcatctccgacacgggctctgcgggcctcatgctcgtcgagttcttcgccccctggtgtggacactgcaagagacttgcacctgagtatgaagctgcagctaccagattaaaaggaatagtcccattagcaaaggttgattgcactgccaacactaacacctgtaataaatatggagtcagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagacccctttaaactgtcttattttccaccagattgagaaccagatgttctctacacactatcactgttcaatagagctttcttcagtgatggaaatgctctgtaatctacactgttcagtacaggtagctacggagcatctgaaatatggctagaaactacatttttgttttgattaatttaaatagccatacagttgctaccatactggtcacggcagctgtagactgactgggtccatagttcatcacctcaaaattctttcaaaatttattatctctttctctccttacatgtttatttcccaggcctaccctggtgattagaacagctgaagggcctttcttgttaggctgtccatgccctaaggatgggttcctgtttatccttgccacgcagctgagcttactgcatgtttatatctcccaaggactgttctctgctcagaaatgccctgtcaagggtgtggcatcacgcagtttcatccaagttgtttcaggaattgctgacactgctgggtgcagttctatcccctaaagcctagggtgtggccctttaacttccccttcagtagaactgggaaaggcagtaccattcctagttatgagtgaagcatccactttcttttgtaacaatgaggaacagaaaggataagactgaagagtgatcttttgtccaactaaaccatttatctccttttgtaggtaaattcaaatcctgcccagttatagttttcagtcactggagaattccaggtaggagccctactttaggtgatcctaggaactcctatgttcagaaaagaattttcttcctactatataattacagtatttagctgtcaattttaagatgaatttggtagagccttatagtaaagtatgtatcttggtcacacacaaagcttggaaaaagtaaaagatgtctaaaccataatcttgtaactcataacatctgggctggggcccggggatctaattgtttagagagccccaaaagtggctcagatgtaaagccagggttaagaaccatctgccttggaagatttaagggaaacatataaacttgtacaaaggacacagaagcagtcagttttaattttttagccatgttggtaaaagttcattttcagtacatgggtaacacccaggccctttcccattatatccaggtatgctacaagttcttttaactcttatcagaagttattattactgtttccttagagaggctaccaggctaaaattcacttagtttggtttgtctaatgtcctcattattttatcctgaagatgatgtcatttctcaggacttgaaaatgacttggctgaactaaaggtaaaaaagccaagcctctgtcacttttcctagactcctaggcacagctatggagtctttgcacagtgcccataccctaaaaattaataatgaaaaccaaacctcaagaacctagagcagctctctacttgccaccatggactccagtggtcagcataagaaaagcagatagttgcattctatttagtttatagctgctttgttcctttgtgtttcactaagcagaggctcaaaaattcccttgataacttcagctgcccctgttcttttcctcaaactccaggatgagacctttaatgtgggacaatttctggtgaaggtactcacagcgacgcttttcttctctgtaacttgggtactgctgcagagaaaaagcatccatgtcaaaaagtaaaaattctcattctaccttgc

SEQ ID NO: 684 - DNA, 4436 bp, Homo sapiens
cctgccgccagaggctccgggttcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatgtggtagaaaagtttttttggttttatctcttttgcgatccctaaattgccacctttctattgtttgaatagtaaaattaatatgaagaactagatagtggtgtaaacaaatgtgataatgtttatttactttcggttctgctcatacttttttgtacaacattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgaagagcttccattacttctgaaaactatatttatctgagtgagtccaaggtgcaactcctaaatgaattgtgttgcagagaactcccagtataattcactgaccagtacattttataaccatccaggccttggtttgcaagcaacagaccttaaacatacaggaaactattaaaattggctcgatcagtagtcataggaattggtataagaagagactcatttagagctcagagttttcttcacataatgggggtattaattatttgtgctgttgcgaaattatgtgtcttattcttaaagccatggtaaaaatagggatctgtgaaggaaatttctaaaattggatgtattaggttttgaactctgagattgcacaaatattcaattaacttgaagttgtgtacatagagaagaaaatttggttttagcaaatgacagagccttcaaaaatatttttggaataatgtgaatcaaccgaaaactgggggcaaggcagaggacaggttttctcaggttaagagaaaaacgaaattttaaaaactttaaaaaatactgataaattcggatcaaatttgggggaataaaaaatattagagcaaaggagtttgctggttgtgtcattatttaatgatcaaagtatagcatgtatgccttattacagacttgttgactataggcttaatgtaaaaaggaatcttgccagatgtagctacttaaggaaaaaagggtttttaatagaaatgaacttttgattagtatggtgccagtcacagggctattttcctgaatattgggtgatgtcaaaggtatatgatacttgaggaaatcaggccaagtgtagctgagcaattaataaacactcaagtttttttagttggggtcatgtcaaaccctcacatggtggttaagtagtgactaactgtgcatgtccttcatggtaggtgagcaccagtctccatgatcaaaaatgccccagtttcctttgaaaaagccactagttctgtgaattgtccttttccctcctgcccctaacagtcctacccctctagcctacattagcatatttctcatgtaatgtattttgctggtaagctcatccattagctgcgtccttcagctattcctttagattggaggaagtggatatgaagatggattgattcagctcaccttccatgattgcttttgagggaaaagctacagtggccacatttcagatgttcacttttgcaatttgtggagggtggagagaggtagacttttgttgtgtgttttataaagtactctcagtaaggagtgtttgagttgaagagtcatctgattcgaggccactcatgttctttgtaacttaaactttgaccaagaaattcttcacttctcacttcttcacttcttcccaatatacagtaagtacgtgagccagtcatccatacactaaggcctagttgagaaaaacctttgattcaggatggctgggttactaaccttgaaatgtaagagatctggttttgaatgtaaaagttgcaacacacaaacggaagtcttaaaaactttttgctctggtcagttacaggtggatccccaataatctgtttttggttttctgatggaaataatagaattaggggaaatcaaatctggttggtaggtgtctacagtattagaagagggtataagggcactgtttaacactaagttctaatacttccagaaactgtgcattccagatctacatactaaatgctcttatcattttgaaatgggctcttgattaatagacccatattttttagtggcttctatgttgtatatttgtctaaaatgaaagctcttttgcgttctaaaactacaatatatgtcatcttattttccctgagtatccaagtatagtgcagattctatgtaaaactactaaatgacactggaatatgtttagtagattagggggaaaaactataaaggtttatacaattgtttgtagttacatttaggatggacttatccctttggagaagagtgaagtttgttttttcgccatgtgatgaagaccactgtgattttttaaaaaagtagataatacttaaaatggcgtaataattctgcacttgaatttgtactgttaacagcacatttggaagattttaaaactttttattgtcttataaatagcattcacttattattttggatatttaagggttccattaagttaacactgtatttggacaaagtgtgaccaaattagccagtctgttttcttccatgtttaattagaagtgagaggtagaagtacttcaaattcaacaggccagcaagcaatcggcttaaaattccctttcttaaatgttgtgctcttatgttctcggctttttaatgactttatttttacagtacttgttcagtcacttgagatgaaatgcttggggtagcttttccatcctcaaacttaatgtttttactagttcatagtgtttggaacagtatatgccaatcactgagactgcatcagagtttgcaattttgtatgtttcattgccaaagaaggcttagtggttgttgactgtagtataagtcagctttctgtagcataagatttgattttcccatacttacttcacttgttatacatcactgattatttgggttaaactggactcatttcaagcagtttgcttttgttcaaatcgtgatgagaaacctaatactgtaatttgatttgagccataaaacacattttaatattagcttgtattatagttattaagcttgtttttgtggaaaaaaacttactaaaacctaggtaactctagattaggccagttcaggtgtattttgtatcttagtaatggatcatatcgtaaaaatagagataagttgggaagatatattgattatgctgttctgttgagggaaaggtcatgtatttagaaatttaaacttttggttattgtgttcacatcatagtattcaagcatcatttatagtttggttttgagaacttttctggtattacgtttatggcaaatgtataaaagaaacaagttttggttatatttttatatttgtaaagtaagtttggttaaagtgatcactgttctttttttattttattgtcatttcaataaaaaatatttgaaagagaa

SEQ ID NO: 685 - DNA, 3497 bp, Homo sapiens
tcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttccctccctga

SEQ ID NO: 686 - DNA, 1596 bp, Homo sapiens
agtgctccgcgcgctcttgacgtccggagcccctggagtaggcgcttccggccattcatactgcagtcggtcagtgttcggttgaaggattctgtgtgctgtcggacccagagggtgacggcgccgctaggatgaagctcgtgagatttttgatgaaattgagtcatgaaactgtaaccattgaattgaagaacggaacacaggtccatggaacaatcacaggtgtggatgtcagcatgaatacacatcttaaagctgtgaaaatgaccctgaagaacagagaacctgtacagctggaaacgctgagtattcgaggaaataacattcggtattttattctaccagacagtttacctctggatacactacttgtggatgttgaacctaaggtgaaatctaagaaaagggaagctgttgcaggaagaggcagaggaagaggaagaggaagaggacgtggccgtggcagaggaagagggggtcctaggcgataatgtctctcaagatttcaaagtcatatgagatttgggatattttttgtacaggttgtgtttgtttatgtcagtttttaataaacataaatgtgggacagagctgtctatttagtatatcaaagttttagtagtttcctccacattcacgaaattaccacagtgagagctaagcatttctactgggcagtttcatttttagttgatcaggttttaagtttttgaactaaaatttttctttttctttttatgatgaataaggttaaaataaaagccttagacaaattaaatttggcagagtttaattgagcaaaggacaattcacaaatcaggtagcccctgaaccataataggctcagaggcttcagcccagctgcatagttgaagatttatggacagaaggaaagtgatgtatggaaaatggaagtgagatacagcaacagccggattagttacagttcagcgtttgccttatttgaatatggtttgaacagttcgctgtctttggttggctgaaacttagtgattgccacaagagtagggtaccgtctgtttacacgtccagttaggctacagttctatgtactgagaaacctttaagctgaacttgagatatgtaaagagactttaggctaaacttaacaatatatataggatatatacccttctacttcacatgcactgaatatgcattttattgctttactcttcattctgtggcacctacccacaggggaagtaagaagtttgttttggtatttcggaaactaaagtccttatgggatggggtctagaattgattctcctttcctgagttttactccacggagtcttaggtacctggtaaaaagttgtcttctaaattaagggtcattgctttgttgtctagctgctaatgtcttacttttgtttcttttgctttttaatcagttcttaataggatatagttttatgttttccaagttataacttggagttaatggtcactagattatcagttatgagcagtgttaaaatctcctattaatgtgtaatgtacctgtcagtgcctcctttattaaggggttctttgagaataaaagagaaaagacctactttatttgacagc

SEQ ID NO: 687 - DNA, 1316 bp, Homo sapiens
gtacaacttccggctgtaaagatggcggcttcctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaacatcagtggggcctcacctgcccgccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgtt

SEQ ID NO: 688 - DNA, 1823 bp, Homo sapiens
gtggagctggggtcactgcgcggtgggaccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgcggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcaccgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgg

SEQ ID NO: 689 - DNA, 1724 bp, Homo sapiens
gaacttttgaatccgccaatcagcgccgcgcgcccccactccgcgggtgcggccgggcgcaggccagggctcgaaggtggggccgcagcggcacggggcggggtctggggcccgccctcccgacacgtggccggggaccgggtatataaggcccttcggggccggccaccctttcactacttctcccccggactccttggtagtctgttagtgggagatccttgttgccgtcccttcgcctccttcaccgccgcagaccccttcaagttctagtcatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattgatgaagttcgcactggcacttaccgccagctcttccaccctgagcaactcatcacaggcaaggaagatgctgccaataactatgcccgagggcactacaccattggcaaggagatcattgacctcgtgttggaccgaattcgcaagctggctgaccagtgcaccggtcttcagggcttcttggttttccacagctttggtgggggaactggttctgggttcacctcgctgctcatggaacgtctctcagttgattatggcaagaagtccaagctggagttctccatttacccggcgccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccacgaacagcttactgtagcagagatcaccaatgcttgctttgagccagccaaccagatggtgaaatgtgaccctcgccatggtaaatacatggcttgctgcctgttataccgtggtgacgtggttcccaaagatgtcaatgctgccattgccaccatcaaaaccaagcgtaccatccagtttgtggattggtgccccactggcttcaaggttggcattaattaccagcctcccactgtggtgcctggcggagacctggccaaggtacagagagctgtgtgcatgctgagcaataccacagctgttgccgaggcctgggctcgcctggaccacaagtttgacctgatgtatgccaagcgtgcctttgttcactggtacgtgggtgaggggatggaggaaggcgagttttcagaggcccgtgaggacatggctgcccttgagaaggattatgaggaggttggagcagatagtgctgacggagaggatgagggtgaagagtattaacctgtgtgctgtacttttacactcctttgtcttggaactgtcttatttttgttctgtaaatgtctattgccgtaaattgttaataaaattgaagtttcc

SEQ ID NO: 690 - DNA, 2105 bp, Homo sapiens
gttgccattaggggactcctgaggtcctatctccaggctgcggtgactgcactttccctggagtggaagctgctggaaggcggaccggccgccatgtccacgttcaggcaggaggacgtggaggaccattatgagatgggggaggagctgggcagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaagccggaaaacatcatgctgctggacaagaacgtgcccaacccacgaatcaagctcatcgacttcggcatcgcgcacaagatcgaggcggggaacgagttcaagaacatcttcggcaccccggagtttgtggccccagagattgtgaactatgagccgctgggcctggaggcggacatgtggagcatcggtgtcatcacctatatcctcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagcggagaatgaccattgcccagagcctggaacattcctggattaaggcgatccggcggcggaacgtgcgtggtgaggacagcggccgcaagcccgagcggcggcgcctgaagaccacgcgtctgaaggagtacaccatcaagtcgcactccagcttgccgcccaacaacagctacgccgacttcgagcgcttctccaaggtgctggaggaggcggcggccgccgaggagggcctgcgcgagctgcagcgcagccggcggctctgccacgaggacgtggaggcgctggccgccatctacgaggagaaggaggcctggtaccgcgaggagagcgacagcctgggccaggacctgcggaggctacggcaggagctgctcaagaccgaggcgctcaagcggcaggcgcaggaggaggccaagggcgcgctgctggggaccagcggcctcaagcgccgcttcagccgcctggagaaccgctacgaggcgctggccaagcaagtagcctccgagatgcgcttcgtgcaggacctcgtgcgcgccctggagcaggagaagctgcagggcgtggagtgcgggctgcgctaggcgcagtggggtgggccaggccccaggacagccggagctcggcctgcggtgggggcgcttcctgtggacgctgcgcctcccatcgcccgggtgcctgtccttgcccagcgccaccaggctggaggcggagtgggaggagctggagccaggcccgtaagttcgcaggcaggggtgggtgtgggacggggctgcttctctacacagcctccacgctggccttcaccttcacccctgcatcgtcggtgaccctgggaccctccaggcagcgtggcctgtggcaccgtgagggttgggacccaccgaggcgcagaggcggcccgaatgcagccctggttcaggcccggaggagggtttgcgggtagttgcacggacaattcggcggggtgctgcctgttgctgccattagcccaggaggaggtcgtgggacggggagggtgggatggacggcggacaggcagtccccacgctgctgggtggcgccgggcttggtggggtcttccactgtgtgcccttctcgccgaggccggtcccccgggtgtggggtgccctgctgcggactcctccgcgagccccatcgtcgcgcctgtggacgcctaggcaagagcggccctctgcagccaagagaaataaaatactggcttccagat

SEQ ID NO: 691 - DNA, 1912 bp, Homo sapiens
attttcttccggtggctggtctccggcggccccgtccccgactgggccccgtgcccccccgcccccgcggccccccgccgccgggccagccgccaccatgaagaaattctttcaggagttcaaggccgacatcaagttcaagagcgcgggacccggtcagaagctcaaagagtccgtgggggaaaaggcccacaaagagaagcccaaccagccagcccccaggccgccccgccagggacccaccaatgaggcacagatggcagccgctgccgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaat

SEQ ID NO: 692 - DNA, 2358 bp, Homo sapiens
ccagggacagcagcccctccagttggaggaggatcagagggcgtggcagcggctggagcagctcatcctgggacagctggaggagctgaagcagcagctggaacagcaggaggaggagttgggtcgactgcgcctgggcgtgggggcgacggactcagagaaaagggttcagcatctgactctggagaacgaggccctgaagcagagcctgagtctcatgcgggacctcctgctgcactggggccccgggccccccatcagggctccgcaggaggaggcagaggcattgctagagctccagggccggcttcaggaggcccaagacaccacagaagccctccgagcccagctgggggtgcaggaggtgcagctgcagggccttcaaggggccctccagcagctccagcaggagacggagcagaactgcaggcgtgagctacagcagatgcatgggcagctggcaggacttcgggcacggatggccagcctgcgtcagggctgcggggacctccgaggtttggtcagcacctttacccagagctgtcagggttcgctgagtgaggcccggggccaggtgtcctgggccttgggggcactgtcatctggagggcctggcactcagctccctgaggggcagcaagggcccccagccggatgcccagggcggctgccagaactcaagggaaatatccgtgtgctgtgtcggctgaggccagggacatcttctagccttgtgagtgtggagcctggcccagggggcaccgtcaccacctgctaccgggggcgccatcgtcgattccgcctagactgggtcttccctccagacgccagccaggaggaggtcttcagagagctggaacctgcggtgctgtcctgcctccgaggctacagcgtctgcatcttcacctatggccagacaggcaccgggaagacctacagcatggagggccctcctgaggaccccggcatagttcctagggcgctgcagtcgctgttccgggagatgggggccggccggcagcaccgcaggtaccacggccggtgcctgagccctgcggagtctccagagcacccgaggcccggccttcccccatgtcgggctcgctcgcccctctaggcacgctgcacctggtggacctggcgggatccgaacgcgcacggaaggcaggggcggccggcccgccgcggggagacccagacggcgcccggcgcctgcgggaggcccagaccataaaccgctcgctgctggcgctaggaggcgtgatggccgcactgcgggcccaccggccgcacgtgcccttccgcgactcgcagctcacgcgactgctgcagccggcgctgggcccaggcaccaccgcggtgctgctgctgcagatctccacgcggccggaggatctcggggagacagtctgctccctcaagttcgccgaccgagtgggtcaagtggagctggggccagcccggcgccgcagggtcccgcgctcctccgggacgccttcttccctcagcaccgacactccgctcaccgggaccccctgcacccctacgccgtcccctggcagtcctccatgccccagtcccgacaacggctcgggctcggctctcgcgcccgcagagggcctgcccctctagtcctgggtcgcggccctgcccatggggtctcaggccaggtctctgctggcagaggcggtagtaaagtccctgtaccccgtctcccagggcacaagctccctagcctctttggatccattgcccctgagctcccagagtcacccctccacctccgcagccagtgaagtgtgttgtgcctgctgaagtgatcaccccccgcccccagccctgcatcaggccacaggtcttggctttctccttatcaccatttgctgttatcacggcacacagcagggaatcccaggcccccccgccaagtggttacccaagtcaccactcctgacccaaaaatcaggcatggcattaaaacgttgcaaattcctttactgttatcccccccaccaccaggaccatgtagggtgcagtctttactccctaacccgtttcccgaaaaaggtgctacctcctttccagacagatgagagagggcaggacttcaggctggatccaccactgggctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccagctgggccacggccatgcgtggggtggcccaataaacaccgtggactccc

SEQ ID NO: 693 - DNA, 3646 bp, Homo sapiens
ggggctgtagggagaggaaggagaaccccggcgtgttgaaggctccgcgaaaccggagcggtgggggactacgcggagggtgggagggattccgagaggagggtcgcgggagccgtgggcgctctcagcccggtgtccgcggtgtaggggttggggcgcgccgggcggcgccgtgagaaacggcgggtctccaggtgcggccgcgggcacctgtttctagtacccccgtccccgcgctcgccttccagccgtgggagccgggccgtgggggcggccgtcgcgagcatgcgcaccggcactgcggcgggcgggcgccgagtctgggcgcggggacgcggggcggcgcgaagcggggccctctgccgccccgcgctcccatgtacgccttttactcgttgctcatctacatcttctacagcctcttccgcagggatggtggcgccgcggcggccgcggagcccggggaccccgcccagagagcccgcaagccccggggtcgccggcgcccagacctgcccgcgccagagctgtggaccgagctgaccggcctggccgccagctccgagcctgaggatgggtcggaaggcgcagccgagggccgcgcggccgcggtgtccctggaagaggccctactgcgcctcgccgagttcctctccgtccagctgggggcggaagagagctgcgggggcccggcggacctgggccagtctggcgaggtcccctcactgttgacagtgaccagtcagctcttggcccttctggcatggcttcgaagccccagggggaggcaggccctgctccaggggactcagccagcccctcgggtccggcccccctctccagatggatccacatcccaagaagaaagcccttcccacttcaccgcagtcccaggcgagccactgggggatgagacccagggacagcagcccctccagttggaggaggatcagagggcgtggcagcggctggagcagctcatcctgggacagctggaggagctgaagcagcagctggaacagcaggaggaggagttgggtcgactgcgcctgggcgtgggggcgacggactcagagaaaagggttcagcatctgactctggagaacgaggccctgaagcagagcctgagtctcatgcgggacctcctgctgcactggggccccgggccccccatcagggctccgcaggaggaggcagaggcattgctagagctccagggccggcttcaggaggcccaagacaccacagaagccctccgagcccagctgggggtgcaggaggtgcagctgcagggccttcaaggggccctccagcagctccagcaggagacggagcagaactgcaggcgtgagctacagcagatgcatgggcagctggcaggacttcgggcacggatggccagcctgcgtcagggctgcggggacctccgaggtttggtcagcacctttacccagagctgtcagggttcgctgagtgaggcccggggccaggtgtcctgggccttgggggcactgtcatctggagggcctggcactcagctccctgaggggcagcaagggcccccagccggatgcccagggcggctgccagaactcaagggaaatatccgtgtgctgtgtcggctgaggccagggacatcttctagccttgtgagtgtggagcctggcccagggggcaccgtcaccacctgctaccgggggcgccatcgtcgattccgcctagactgggtcttccctccagacgccagccaggaggaggtcttcagagagctggaacctgcggtgctgtcctgcctccgaggctacagcgtctgcatcttcacctatggccagacaggcaccgggaagacctacagcatggagggccctcctgaggaccccggcatagttcctagggcgctgcagtcgctgttccgggagatgggggccggccggcagcaccgggtgacactcagcatggtggagatctacaatgaggctgtcagggacctccttgctccagggcctcccgagcgcctggccgtgaggcagggcccagaaggccagggcgggatccaggtggctggcctcacccactgggacgtgcccaacctggagacattgcaccagatgctgaaactggggaggagcaaccgggccaccgccgccaccgccatgaaccagcgcagctcccgctcgcatgccctggtcacgctgacgctgcgcgcggcgtctccaccgcgcgctccaggcaccgcaggcacgctgcacctggtggacctggcgggatccgaacgcgcacggaaggcaggggcggccggcccgccgcggggagacccagacggcgcccggcgcctgcgggaggcccagaccataaaccgctcgctgctggcgctaggaggcgtgatggccgcactgcgggcccaccggccgcacgtgcccttccgcgactcgcagctcacgcgactgctgcagccggcgctgggcccaggcaccaccgcggtgctgctgctgcaggtgggcgccggggcggggcaggtgtgtgcgtgccggtcgccgcccacccgggcccgcccacccgcgcctcttgcccgcagatctccacgcggccggaggatctcggggagacagtctgctccctcaagttcgccgaccgagtgggtcaagtggagctggggccagcccggcgccgcagggtcccgcgctcctccgggacgccttcttccctcagcaccgacactccgctcaccgggaccccctgcacccctacgccgtcccctggcagtcctccatgccccagtcccgacaacggctcgggctcggctctcgcgcccgcagagggcctgcccctctagtcctgggtcgcggccctgcccatggggtctcaggccaggtctctgctggcagaggcggtagtaaagtccctgtaccccgtctcccagggcacaagctccctagcctctttggatccattgcccctgagctcccagagtcacccctccacctccgcagccagtgaagtgtgttgtgcctgctgaagtgatcaccccccgcccccagccctgcatcaggccacaggtcttggctttctccttatcaccatttgctgttatcacggcacacagcagggaatcccaggcccccccgccaagtggttacccaagtcaccactcctgacccaaaaatcaggcatggcattaaaacgttgcaaattcctttactgttatcccccccaccaccaggaccatgtagggtgcagtctttactccctaacccgtttcccgaaaaaggtgctacctcctttccagacagatgagagagggcaggacttcaggctggatccaccactgggctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccagctgggccacggccatgcgtggggtggcccaataaacaccgtggactcccagcaaggctgctgcctggtgtttcgaggctgctgtggtcgcagacagccgcctcgccttggctccctgtcaacaaggtgggggtggg

SEQ ID NO: 694 - DNA, 987 bp, Homo sapiens
cgccgtgcacgtcttggttcgggccgggcataaaaggcttcgcggcccagggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggaggcttgggccccctgaacatccccctgcttgctgacgtgaccagacgcttgtctgaggattacggcgtgctgaaaacagatgagggcattgcctacaggggcctctttatcatcgatggcaagggtgtccttcgccagatcactgttaatgatttgcctgtgggacgctccgtggatgaggctctgcggctggtccaggccttccagtacacagacgagcatggggaagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtgtga

SEQ ID NO: 695 - DNA, 1612 bp, Homo sapiens
gagcatcaccgcagaaacaaaggctccagcctccggacaccatgtctgtgcgcttttcttctacctccaggagacttggctcttgcgggggcactggctctgtgaggctctctagtgggggagcaggctttggggctggaaacacatgcggtgtgccaggcattggaagtggcttctcttgtgcttttgggggcagctcatctgcaggaggctatggcggaggtctgggcgggggaagtgcttcctgtgctgccttcacagggaatgagcacggcctcctctctggcaatgagaaggtgaccatgcagaacctcaacgaccgcttggcctcctacctggagaatgttcgagccctagaggaggccaacgctgacttggagcagaagatcaaggggtggtatgagaaatttggacctggttcttgccgtggccttgatcatgattacagcagatatttcccaattattgacgaacttaagaaccagataatttctgcaactaccagtaatgcccatgttgtcctgcaaaatgataatgcaagactaacagctgatgacttcagactaaagtttgaaaacgagctagcgcttcaccagagcgtggaggcggacatcaatggtttgcgaagagtcctggatgagctgaccttgtgcagaacggacctggagatccagctggaaactctcagtgaggagctcgcttacctcaagaagaatcatgaggaggaaatgaaagctcttcagtgcgcggctggaggcaacgtgaacgtggagatgaacgcggcccccggggtagacctcacggttctgctgaacaatatgcgagctgagtacgaagccctcgcagagcagaaccgcagggacgcggaggcctggttcaacgaaaagagcgcctcgctgcagcagcagatctctgacgacgctggcgccaccacctcagcccggaatgagcttatcgagatgaaacgcactcttcaaacccttgagattgaacttcagtccctcttagcaacgaaacactccctggagtgctccttgacagagaccgagagtaactactgtgcacagctggcacagatccaggctcagatcggggccctggaggagcagctgcaccaggtcagaaccgagaccgagggccagaagctcgagtatgagcagctccttgacatcaaggtccacctggaaaaagaaattgagacctactgcctcctgatagatggagaagatggctcctgttctaaatcaaaaggctatggaggcccaggaaatcaaacaaaagattcatctaaaaccaccattgtcaaaacagttgttgaagagatagatcctcgtggcaaagttctctcatccagagttcacactgtggaagagaaatccaccaaagtcaacaacaagaatgaacagagggtgtcttcctgaactccagcctctgagacagaatggcccccaaattaaaataccaaaatgaagctagtttcctaaataagggtccccttatttttctgcttttcttccaatgaattaagacaagttatttttagaatagtaccatttctttggctttttctctatggtggtgtttcaataaaagttcttcctgttgcaagtca

SEQ ID NO: 696 - DNA, 1376 bp, Homo sapiens
tgaaaatgccgtcggtttcgaaagcggcggcagcggcgctgagcgggtcccccccgcagactgagaagccgacccactacaggtacctgaaggagttcaggacggagcagtgccccctgttttcacagcacaagtgcgcgcagcaccggccgttcacctgcttccactggcacttcctcaaccagcggcgccgcaggcccctccgcaggcgcgacggcaccttcaactacagccccgacgtgtactgctccaagtacaacgaagccaccggcgtgtgccccgacggcgacgagtgtccctacctgcaccggacgacgggggacacagaacgcaagtaccacctgcgttactacaaaacaggaacctgcatccacgagacagacgcacgtggccactgcgtgaagaatgggctgcactgtgccttcgcgcacggccccctggacctgcggccgcccgtgtgtgacgtcagggagctgcaggcccaggaagccttgcagaacggccagctgggcggcggggaaggggtcccggatctgcagcctggggtcttggccagccaggccatgattgagaagatcctgagcgaggacccccggtggcaagatgccaacttcgtgctgggcagctacaagacggagcagtgcccgaagccgccacgcctgtgccgccagggctatgcgtgcccacactaccacaatagccgggacaggcggcgcaacccccggcggttccagtacagctggcagctgggacgccgggtccttaggctgagtcccagggccaacaacccaagggtcgccctgcccagggtgcacacaggaccttcctccaccgcctgagccccagctgtcccctgggtctggcttgtgggtttggcacctcgcagcctgcttgcctctgaagcccctttctcctccttgctccagcccggccttctggttgtgcctggcctggcttgcctcctgtctgcagtttgcacctgagaggggggtgggggggtgcagaccccacagggtgtctggatgcctgggccatggccttggcctccctgaggccctgtctgtgtccagctcttcctttgagcagagagccaccctcgcctcttttgaatgacctggtgctgcctcgcatgccccggagagcacctgtgcttcctttgggaaggacgccccactccttgttgttatgccacgttcagtctccctctgagcagcttccgagtaaaggacctgaacggctgtagaacaaaccacaaattagtgtctgagattttgtcatcgcccgtcatggaaagaaaataaaaattattttttcaacaggcacttaatgtgtcccataaatacaaatcagttacaataaagcagctagagattcca

SEQ ID NO: 697 - DNA, 1271 bp, Homo sapiens
ggcgccggcctcggcggctgaggaaagcaggaggaggtggcggcggcgggaagatgacgcgcacctttccggaggatgggggaggtaaccgaggtcctgagccggtacctgaacttgggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgca

SEQ ID NO: 698 - DNA, 6391 bp, Homo sapiens
acagccggtgggctcggtggggctgcagaaggtcggggctgcactgctctcggcccccacacggttggttggttggcgtggtaagtgccctgatccctggtcctgagaactcaggctggcacagggattcccagggcatctaccaccacgcagctggagcagggctgagcccaggagcatggagatggacgcccccaggccccccagtcttgctgtccctggagcagcatcgaggcccgggagaactgtggacaacggaaggctgagccccatccattgagttcctggggccccactggaggggctgctgtggccagggtgcacggtgaggaggcgagcagggtgggtgggggcgagttcccggcctgccctctcttcacagctcctggaggtgatccccgactccatgaggaagcaagaggtgcggacgggcagggaggccggccagggccacggtacgggctccccagccgagcaggtgaaagccctcatggatctgctggctgggaagggcagtcaaggctcccaggccccgcaggccctggataggacaccggatgccccgctggggccctgcagcaatgactcaaggatacagaggcaccgcaaggccctgctgagcaaggtgggaggtggcccggagctgggcggaccctggcacaggctggcctccctcctgctggtggagggcctgacggacctgcagctgagggaacacgacttcacacaggtggaggccacccgcgggggcgggcaccccgccaggaccgtcgccctggaccggctcttcctgcctctctcccgggtgtctgtcccaccccgggtctccatcactatcggggtggccggcatgggcaagaccaccctggtgaggcacttcgtccgcctctgggcccatgggcaggtcggcaaggacttctcgctggtgctgcctctgaccttccgggatctcaacacccacgagaagctgtgtgccgaccgactcatctgctcggtcttcccgcacgtcggggagcccagcctggcggtggcagtcccagccagggccctcctgatcctggacggcttggatgagtgcaggacgcctctggacttctccaacaccgtggcctgcacggacccaaagaaggagatcccggtggaccacctgatcaccaacatcatccgtggcaacctctttccggaagtttccatctggatcacctcccgtcccagtgcatctggccagatcccagggggcctggtggaccggatgacggagatccggggctttaacgaggaggagatcaaggtgtgtttggagcagatgttccccgaggaccaggcccttctgggctggatgctgagccaagtgcaggctgacagggccctgtacctgatgtgcaccgtcccagccttctgcaggctcacggggatggcgctaggccacctgtggcgcagcaggacggggccccaggatgcagagctgtggcccccgaggaccctgtgcgagctctactcatggtactttaggatggccctcagcggggaggggcaggagaagggcaaggcaagccctcgcatcgagcaggtggcccatggtggccgcaagatggtggggacattgggccgtctggccttccatgggctgctcaagaagaaatacgtgttttacgagcaagacatgaaggcgtttggtgtagacctcgctctgctgcagggcgccccgtgcagctgcttcctgcagagagaggagacgttggcatcgtcagtggcctactgcttcacccacctgtccctgcaggagtttgtggcagccgcgtattactatggcgcatccaggagggccatcttcgacctcttcactgagagcggcgtatcctggcccaggctgggcttcctcacgcatttcaggagcgcagcccagcgggccatgcaggcagaggacgggaggctggacgtgttcctgcgcttcctctccggcctcttgtctccgagggtcaatgccctcctggccggctccctgctggcccaaggcgagcaccaggcctaccggacccaggtggctgagctcctgcagggctgcctgcgccccgatgccgcagtctgtgcacgggccatcaacgtgttgcactgcctgcatgagctgcagcacaccgagctggcccgcagcgtggaggaggccatggagagcggggccctggccaggctgactggtcccgcgcaccgcgctgccctggcctacctcctgcaggtgtccgacgcctgtgcccaggaggccaacctgtccctgagcctcagccagggcgtccttcagagcctgctgccccagctgctctactgccggaagctcaggctggacaccaaccagttccaggaccccgtgatggagctgctgggcagcgtgctgagtgggaaggactgtcgcattcagaagatcagcttggcggagaaccagatcagtaacaaaggggccaaagctctggccagatccctcttggtcaacagaagtctgacctctctggacctccgcggtaactccattggaccacaaggggccaaggcgctggcagacgctttgaagatcaaccgcaccctgacctccctgagcctccagggcaacaccgttagggatgatggtgccaggtccatggctgaggccttggcctccaaccggaccctctccatgctgcacctgcagaagaacagcatcgggcccatgggagcccagcggatggcagatgccttgaagcagaacaggagtctgaaagagctcatgttctccagtaatagtattggtgatggaggtgccaaggccctggctgaggccctgaaggtgaaccagggcctggagagcctggacctgcagagcaattccatcagtgacgcaggagtggcagcactgatgggggccctctgcaccaaccagaccctcctcagcctcagccttcgagaaaactccatcagtcccgagggagcccaggccatcgctcatgccctctgcgccaacagcaccctgaagaacctggacctgacagccaacctcctccacgaccagggtgcccgggccatcgcagtggcagtgagagaaaaccgcaccctcacctcccttcacctgcagtggaacttcatccaggccggcgctgcccaggccctgggacaagcactacagctcaacaggagcctcaccagcttagatttacaggagaacgccatcggggatgacggagcgtgtgcggtggcccgtgcactgaaggtcaacacagccctcactgctctctatctccaggtggcctcaattggtgcttcaggcgcccaggtgctaggggaagccttggctgtgaacagaaccttggagattctcgacttaagaggaaatgccattggggtggctggagccaaagccctggcaaatgctctgaaggtaaactcaagtctccggagactcaatcttcaagagaattctctggggatggacggggcgatatgcattgccacagcactgtctggaaaccacaggctccagcatatcaatctccagggaaaccacattggggactccggggccaggatgatctcagaggccatcaagacaaatgctcccacgtgcactgttgaaatgtgatcctggtggacggatcaggagaatgggcagatgctcagctggaagcttttgaacagaaaggccgacttctggggggcctgtctgggagctgggaacgctgcttgctcagcacgagagccgggctctgcagggaggaaggagaggtgctgccggaggaggtcgtgagctcctcttctgctgcaggagtggtccaggcagggggtgacgggtactctgttatggcacagagaagggaggggccacccccaagggactaggggccaaaggcctgaaagctgagcagtacaggaggctggttccagctttacaccctgaggacttcatgtgtccccaacctttaaaaatgtttattactgcccctttccactcacctggttaaaaatcatcccatgctctgagatgagctgccacctcaagcccgtgaggagcatccgtttggtaggggtaacagaggggacccttctttatcttctcaagaagaagatttcagggtatcatccttacagacatgaaaaagctatgggaaaattgtgaagataaatgaaagttttaattctaggattctggaaacagagacagtaagagttctccaaggattttgccttttttgtttgtttttgagatggagtctcgctcttgtcgcccaggctggagtgcagtggcacgatctcagctccctgcaacctccgcctcccgggttcatgtgattctcctgcctcagcctccccagtagctgggaatacaggcacccgccaccatgcccggctaatttttgtagttttagtagagacggggtttcatcatgttggccaggctggtctcgaactcctgacctcaggtgatccatcagcctgggcctcccaaagtactgggattacaggcatgagccaccacacctggccccattttttatttattacaaaatcaaagacatgggtgatgcctggcacatgttgtctggagtctggcacactggttatcaatagcacattcagtgtattcagtgatgtcattctttatttatttttgagacagaatctgtcacccaggctggagtgcagtggcatgatctcagctcactgtaggctctacctcatgggttccagtgattctcctgcctcggcctcccaagtagttgggtctacaggcacgcaccaccacacccagctaatttttgtatttttagtagagatggggtttcaccatgttgatcaggctggtctttaactcctgacctcaagtgatccacccacctcagcctcccaaagtgctgggattacaggtgtgagccactgcacctggcagtgatgtcattccttactaggcttccaaagccactgctgtggccacagcttccatggagacaggcaagctgagcctctatgtggcaccaattcctgcagctgtttgtgttggagggaaaaaaatccaaatggacatcaacagctttcatcaactaaataaccacagaaaatatttatgaagactataaagcaatgattacttttgaattggaaaggaatcactattatttgaaatgtttcttcaaaagtgagcatccggacaggaaccatcatggatgctgaggccatggatgaaggcctactcgggaagatgatatccttgcagtctcaaaacggcaccccacaaaggtgatatcctaatttacaaagggaaaaaggtaccttaatctgaaatctggcaaatgcagcctcaacagaagtgacagaattgaacatcgccaataatgggacacacagacatcacatgcccccagtctgatgcaccacggagtcgtctctgatgtattcttgtcaaaaaatgtttgcctgattctaatcatgaaagaacaattagaaaaaatccaaattgacagatattctgcagaataaatggcctgacctcatcaaaaacatcaatgtcatgaaaaacacaaaacattgcagatagcgtgaaattaaagattacagagatataatttaatgcaagatctctgactggatcctagactgcaggaaaaagtctgctataaagaacatttggatcacttgtagtagctgggaaataaaacaaaacattatttgtaaaaggggggaaatctgaacatgggtcttgcagtatttatgacagtttttgcggggcagagatttctagattgacagctgttttagtactttcaaggtgatgctctgtctgctggtttgcattgtttctgtctgagttaagagactggcagaacacagagttgcagtagccaaacactggagaaagctgggccctacagaaacctaacgctgaagaaacctcaggagccaaactggtggagaaaacaaagagtcctccctctctcccttttcaaataatgatcatacatcttcaagctgtctgaaatggttaaggagttcagtctgtcgtcaggcacacaccagagccagctagcccacacagaccccatcagagcaaaacagacaagagaatttaattcatatccacatagaaaggacttctaggtaggaggtagaccctttagctcccttccaattaaaggagtccccaattctggcacctgagagtcccctgggtctaacagctatgatatttatgtagtgtgttgcttacctaaatgaatacaatttccttccagacacgtgacactgatattaaagtgctaatgagagggatctatttcttcttgtacgctaaaagagaaacagcagttcagatttcccatcagaagtccgaggactttgttcttgataactactaccaataaaaattgagtatttg

SEQ ID NO: 699 - DNA, 2182 bp, Homo sapiens
gaccagagcggttgcgggctgagcggtttcgagccggcgtcggggagcggcggtaccgggcggctgcggggctggctcgacccagcttgaggtctcggcgtccgcgtcctgcggtgccctgggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagcccaggaggtcaaagctgaggtgagccatgattactccactgcactccagcctgggcaacagagccaggccctgtatcaaaaaaaaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttg

SEQ ID NO: 700 - DNA, 1513 bp, Homo sapiens
gcccgggctacacgttaaaaacactaaggggagcgcgcgaagctgaacttggcgctcgatgggggccgttagccgccctagagcgcgcggagccgcagaggcgtagctggactacaacgcagtgcatctcgggaggccaactcgactggactgggtgagaggacagaggtggctcgatgggcggcccgaaggccggggatcatggcgggaaggcgggcccagacaggttcagccccgccccgacccgccgctccccaccccccggcctcgcgtgccttcccgcagcactgccgtccccgggatgctgagcgcccaccgtctccccgcagccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgctcctggacctggcgctgcagggagcgggcgacgccgaggcagctgtggtgctggaggcggcgctggccacgctgctgaccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctgggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggt

SEQ ID NO: 701 - DNA, 1153 bp, Homo sapiens
cgcttcccctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccagggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgtaca

SEQ ID NO: 702 - DNA, 825 bp, Homo sapiens
cacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctca

SEQ ID NO: 703 - DNA, 3282 bp, Homo sapiens
ctggtctgcggctgagatacacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgtaaggattgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctc

SEQ ID NO: 704 - DNA, 2901 bp, Homo sapiens
tggcgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggctaggcatcgtggaaccagctccagcccctgaagaaacgatagatgtgcaggttgtgcggaagaggctgagtggaaaatggtgtgagccccaccgctgtgcatcgaatgagggaagtggcagcagagaggccagagctgccccctctctgtctcttcaatggacccttcacaagtgtttctcctgcccttggggctgtcttccttctcctgaaatccagagactttcttgctcatcccttctccctttcacttctgttctctgctgcagaaagcagacttgcatatccctgatgagcagctcggctacttttgtaaacttcagatttggagagaaacacgaaagtctgaatcctgaccccttgagagagagtgatctggcgagggccgatgaaggggctgggcctggtcttgccttctcttctctcggttgctccctctgcctaggcccctggtactcagtcacggcagccaggagaccccaggtgagtttctgagcgcatacgtagttggttcttacccccaggtgtcacacggggccgagagctgagcaagaatttggaatggaagttatgaccaagggaattatgctgttcatttataatagtggacattatggagagctctgattcctacataatatgaataaggatggataggccgggcgtggtggctcatgcctataatcccagcacgttgggaggctgaggcgggcggatcggttgagctcaggcgttcgggaccagcctggccaacatgatgaaaccccgtctctaccaaaaatagaaaaaaatatagccgggcctggtggcgcacgcctgtagtcccagctactcgggaggctgaggtaggaggatcgcttgagcctgggtagaggctgctgtgagctgaaatggcgccactgcactccagcctgggtaacagagcgagaccccgactcaataaataaataaggatggataaattgtagcgtatgcaccattcattatgctaagacattttaaagtaattatgagaaacgctctactaatgatttgtttttatttgtatttttctgcttattagacaaatatatactcatttt

SEQ ID NO: 705 - DNA, 2995 bp, Homo sapiens
agaatgatgatgtcgcacgctgggtgggaactgacgtcacctgtgctcaccgccgcttccggtccgcgtgaggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggctaggcatcgtggaaccagctccagcccctgaagaaacgatagatgtgcaggttgtgcggaagaggctgagtggaaaatggtgtgagccccaccgctgtgcatcgaatgagggaagtggcagcagagaggccagagctgccccctctctgtctcttcaatggacccttcacaagtgtttctcctgcccttggggctgtcttccttctcctgaaatccagagactttcttgctcatcccttctccctttcacttctgttctctgctgcagaaagcagacttgcatatccctgatgagcagctcggctacttttgtaaacttcagatttggagagaaacacgaaagtctgaatcctgaccccttgagagagagtgatctggcgagggccgatgaaggggctgggcctggtcttgccttctcttctctcggttgctccctctgcctaggcccctggtactcagtcacggcagccaggagaccccaggtgagtttctgagcgcatacgtagttggttcttacccccaggtgtcacacggggccgagagctgagcaagaatttggaatggaagttatgaccaagggaattatgctgttcatttataatagtggacattatggagagctctgattcctacataatatgaataaggatggataggccgggcgtggtggctcatgcctataatcccagcacgttgggaggctgaggcgggcggatcggttgagctcaggcgttcgggaccagcctggccaacatgatgaaaccccgtctctaccaaaaatagaaaaaaatatagccgggcctggtggcgcacgcctgtagtcccagctactcgggaggctgaggtaggaggatcgcttgagcctgggtagaggctgctgtgagctgaaatggcgccactgcactccagcctgggtaacagagcgagaccccgactcaataaataaataaggatggataaattgtagcgtatgcaccattcattatgctaagacattttaaagtaattatgagaaacgctctactaatgatttgtttttatttgtatttttctgcttattagacaaatatatactcattttaaaaa

SEQ ID NO: 706 - DNA, 4533 bp, Homo sapiens
aatgaggacgcgtggacgcgcggcacgccggtcctggctacaggcgcggcgtttgaagaaaaactgtcactgaagagtcatggtggggcccgggcctaccgctgctgccgctgtcgaagagcggcagagaaagcttcaggagtaccttgcagccaagggaaaactgaagagccaaaacaccaagccttatctaaaatccaagaataattgccagaatcaaccaccttctaaatctactattagacccaaaaatgatgttaccaaccatgttgttttgcctgtcaaacctaaaaggtccatcagcattaaactccagcccagaccacctaatactgcagggtcccagaagccgaagttggagccaccaaaacttctgggcaaaaggctgacttcagaatgtgtttcttctaacccatactctaagccttctagcaagagttttcaacagtgtgaagctggatcgtccacaacaggagaactgtcaagaaaacctgtggggtcacttaatatagagcaattgaaaactacaaagcagcagttaacagatcaaggaaatggtaaatgtatagactttatgaataatatccatgttgaaaacgaatctttggataactttctaaaagaaacaaacaaagagaacttgctcgatatcttaacagaacctgagaggaagccagatcctaaattatataccagaagtaagccaaagactgactcttataatcaaaccaagaacagtttagttcctaaacaagccttgggcaaaagttcagttaatagtgctgttctgaaagatagggttaataaacaatttgttggagaaacacaaagcaggactttcccagtaaaatcacagcaactctctagaggagcagatcttgcaagaccaggagtaaaaccctcaaggacggttccctctcactttattcggacccttagtaaagttcagtcatcaaagaaaccagtagtcaagaacatcaaagatataaaggttaataggagtcaatatgaaagaccaaatgaaactaagatacggtcataccctgttactgaacagagagtgaagcacaccaaacccagaacataccccagtttgcttcagggtgaatataacaacagacatccaaacatcaagcaagatcagaagtccagccaagtttgtatacctcagacatcatgtgtactgcaaaagtcaaaagccataagccagaggcctaatttgacagttggcagatttaattcagccattccaagcacccctagcataagaccaaatggaaccagtggtaataaacataacaataatggctttcagcaaaaagcacagactttggactccaagttgaaaaaggctgttccccagaaccattttctgaacaagacagctcccaaaactcaagctgatgtcacaaccgtaaatgggacccaaacaaacccaaatattaaaaagaaggcaacagcagaggatcgaaggaaacaactagaagaatggcagaaatctaagggaaaaacctataaacggcctcctatggaacttaaaacaaaaagaaaagtaataaaggaaatgaatatttcattctggaagagcattgaaaaagaagaggaagaaaagaaagcacaactcgaactgtccagtaaaattaacaacactctgacagaatgtctgaacctcatcgaagggggtgtaccttctaatgaaatacttaacatattgtccagcattcctgaagctgaaaaatttgctaaattctggatctgcaaagcaaagttgttggcaagtaaaggcacctttgatgttattgggctatatgaagaggccattaaaaatggggcaacaccaatacaagagttgcggaaagttgttcttaatatcttgcaagactcaaacagaaccacagaagggattacttctgactctttagttgctgaaactagtataacatcagtggaagagctggccaagaagatggaatctgtgaagtcttgtctttctccaaaagagagggaacaagtcacggcgacaccccgaatagccaaggcagaacagcataattatcctggtatcaaattacagattggtccaatccctagaataaatgggatgccggaagtgcaagacatgaaatttatcactcctgtacggcgttcgtcgaggattgagcgagcagtgtcccgctacccagaaatgctgcaggaacacgatttagtagtggcttctcttgatgaactgttagaagtggaagaaacaaaatgttttatattccgtagaaatgaggcgctgcctgtaacattggggtttcaaacccctgaatcataatttcttgatgctttttttaaaaaaggtgtttcagaaccaacataagacaagaaatattcttgtccaagtgacctggaaaaaaagagaggcatcatggatgcagattatggacgctcaggacttaagtaattcactgggcttactctcaaattttctctccccatgggaaaatctttgctttatgtgtttaagaccagtttgccagttttacagtatacataaatttcaaacttttgaatatttaccctacaactatgataaatatttatactttattgatctactttaatcccaacatagttttttatatcagaaggttggtcccacaatataatgggacttttctttctgcatccaccttagcagagggcaagttctttcatcgtggaagatctgaactttgacgctagcttgacaggctgaatggaccttgacagatggccaagtcaaaacccctcattttacagatgagtttatgctagctgtgcctttgctcagagatcataaatttatgtgtgatctttgactttcatcacagtatccttgtaaatgagagagaattcttgttttttctatgccaggtctcctcagatgaaacacaatcctgaattggcatggtcgtctagcttttatattcaaacctagttttgcatttgttactcagaaacacttcaagtaacaaaaggggggcaggggagaggggtggggagtggacacttgcttcttcagttctttgctcagctagggtatagctggcctgagaaggcagtgcaagccccagagactgttgtaggttgctttttcttcctcctgggcaactatttgtggaaaggttttaccttagtcattatgtaaatataattgtgtagaaaaacctagtcaacacattttaaattttagctttcttaatatttaagtattatcttaaaacaacattaaatttctattagttcctgcttgtttatcttatttattatagaaaaccatgataatggctttgcatagagaattaggagtttgtctaaggatataccagttggctgtcctaagaaacaaggagcattcattaccaaggagaatggactttgatcaaaggtctatcagcctcatccaggaactagatttttttaagggaagcagatctatttctgaaagtcagatttataataaagctcaaaaaactgagctataaacctgtaataccagcagactttcaataagagactcttacaactcaattgtggaaaaactaataattaaaaatgggcaaaggacctgagcagacatttctccaaagaagacataagaaatggccagtaggtatagatatgaaaaggtgttcagcatcattaatcataagaataatgtaaattaaaaccactgtgagctatcacctcacatctataagaatggctattaacaagacatgagataaatgttgatgagattgtggagaaaagagaaccctagtacactgtttgtgggcgtgtagactggggcagccgttatggaaaacggtatggaggctcctaaagaaattaaaaatagaactgttatctgaccctcttctgagtaagtatgtacccaaagaagatgaaatcaccagctgggcgcagtgactcacacctgtaatcccagcactttggagtgggtgaatcacctgaggtcaggagttcaagaccagcttgaccaacatggtgaaaccccgtctctactaaaaatacaaaaagtaggcgggcatggtgacgggcacctgtaatcccagctacttgggaggctgaggcagaagaatcacttgaactcgggaggtggaggttgcagtgagccaaaattgcgtcactgcactccagcctgggttacagagcaagactccatctcaaaaaaaaaaaagatgaaatcatcacctcataaagatatctgcactcacatgtttgtggcagtgttattctcaatagccaagatgtggaaacaacctaaatgcccatcaatggacaaataaagaaaatacggcatatgcatgccgtggaatagtattcatccttggaaaagagggagttcttgccatttgccacaacatagatggacctggagaacattatgctaagtgaaataagccagacccaaggaaaaatactgcatgatctcacatatggaatatttaattttttaagaaagagctcaagtacacagagaaagtgcttaccacagattgggga

SEQ ID NO: 707 - DNA, 1667 bp, Homo sapiens
gagcgacgcgtacgtctacctgcctgccttacagggcacctaggagggaccccttcctggcccatccgcgccgcgcaggcgcacgcccacgcagcgcctagacgcccgagccgagcgtcccgtctcctagtaaccagccgctagcccccttttccacgactcatttcttaatctctgcctgaggctgccgcacctggatggaacgcgcatgcgcaaggctgtctctcgcagccccgccttccctcagcttgaaacacctgctgcttcgcggcggtggctttgtgccacttttcccagggcttgggcatcattctggacccatgttcggtgaaccggttactctcagagctgctttcgggcgcagctcctgctgcagccagggcccgttttaagagaggcttccaggtccagccctcccgctgcagcctgcagggagcgagccggcctgtcccgatgacatagacactaggtttttacagcaattctctgatgaccttgatatggtagaacgctgtgtatttcaagagtaagctctcgtttgaggagactaacaattcctgttttcgccagatttcttcttgaatggcaacctaaatgccagtccaaagaggcccccaatagacttgttcacccttcatgtcctcaactctggggaagttaagtaatcaagttgaagaaacacttccactacttaaaaaggtacctgcaaattactttcacatttgttcagctatcctaatgggattttcacttagtaaatctgctactcaggtatctgctatacatatggattcaaaagtggatgatcacttaatacgagggactgaaaaaagcaggttggaaccagcgactcagttatttcaaaacaccaagaaaataagattagaagacacaaatcaagaaaactttacaaggattgaagggactggcacaggatctctttctgggaaagccttgggttcagtggtatatgtcaaagaaagtgatggactagaaatgacagatgtggaatgaagcaatttgtacgtattaccaaagaaaccaaaaactgcctttgactaaggggggtgttgaaagagaacttaaccttattaggaaaccctgacaaaatgatggaagactattgccttattttgcactatttgtgaatcatcttacactgcatttttttatgatgcttattcaaaaggcagttgctttagggtgaaaaagccttccaagattcaaagcagatttctctggtattatattatatccttcttaaaaaccagagtttttaagtaacagtatttgaatggcatcaaaacattttcattttaatgtatttctttaacaagtggttaaaaaaagtgtccaagcagccgggcgcagtggctcacacctgtaatcccagcactttgggaggccaaggcgggtcaatcacctgaggtcaggagttcgcaaccagcctggccaatatggtgagaccccatctctactaaaaatgcaaaaagttagccaggcatggtggtgggcacctgtgatcccagctacctgggaggctgaggaaggagaatcgcttgaaccctggaggcggaggctgcactgagctgaggtcatgccattgtactccagcctgggcaacaagagcaaaactccgtctcaaaaaaaaaaaaaaaaaaaaaaaa

SEQ ID NO: 708 - DNA, 5833 bp, Homo sapiens
agatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattctggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattcttt

SEQ ID NO: 709 - DNA, 1147 bp, Homo sapiens
gcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaagggtgtgagccaccgcacctggcctaaaccagatttctttagggcacaattttttctggaatctcactcttgtttttcaaattttaaaaacgtttctactccaattaagaatatatatgatgttattatatatgcttatgaaacagatttatga

SEQ ID NO: 710 - DNA, 547 bp, Homo sapiens
gctgcaggaaaggtaggacctgatggctccaggccctcggaggctcagaggcgcagggctgagccatgggaacgaagcgcgaggccatcctgaaggtgctggagaacctgacaccggaggagctcaagaagttcaagatgaagctggggacggtgccgctgcgcgagggctttgagcgcatcccgcggggcgcgctcgggcagctagatatcgtggacctcaccgacaagctggtcgcctcctactacgaggactacgcagccgagctcgtcgtggccgtgctgcgcgacatgcgcatgttggaggaggccgcacggctgcagcgggctgcgtgagggccactctgagctggaggcgggtcaaggcaaaaggagtaatgcaacgcctgtgaagccagccccacgcgcgcaccagtcgcgtaagacaacagcagtgtctccacctcggggaccaaggacgcctccgtgcctccagaccccgcctcctccagcccctgcacctgtcatttattcttccactgcccaataaatattcatggcagacttta

SEQ ID NO: 711 - DNA, 1109 bp, Homo sapiens
tttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacatt

SEQ ID NO: 712 - DNA, 3650 bp, Homo sapiens
ggggcgcggggcgcgggggctgtagggagggggaccagtggcagagggaccttaggtgatccttagaaataaaggctagcttctgttcgaccttggagtagggcgaagaggtgtagacaggcctggagaagcgaggtaaaagcctgagtaaaagcaagaagttggagaatatgagatacatctcatctctagtaaatacttaaatgacttcccctcctcccggagtcaagcacaattcggggatgcaatgacggacgtaggtgaagacactgcgggaacttacagacaaaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagagacaaaaacagcagaaccatactacaggttaa

SEQ ID NO: 713 - DNA, 552 bp, Homo sapiens
ggaggccgctgggacgcggttcagctcattccctgaggccggcccgcgtcccgtcaggcgccgcgcggggttagcgcggggtcagcggaggtcagcgggggtcagcagcagcggctccgagggcgcggcggacgcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaaggacaagacaaagtgtggggacctggggaccctgcactcctccaaagtgagtgcctcctttcggctcagagaccttgctgctgaccaccacaggacacagaaatggcaaagaccagatgtggggacggcaggatggctgcctctcccctga

SEQ ID NO: 714 - DNA, 1426 bp, Homo sapiens
gaggaaagaggcgcgttcctagccgcgggactgggtgacccgcctctcccccaaattagctgcttggaaagaggaccaaagacgtctaaaaagtcatttggaaatatctctaaatatttgttaccatgtataagctgctaaagagaaattgggcccaacaaaactaattgaataattgaggcagatttgtgtgtatcatcaaattctatccagaagttgaagaatctgaatttaaagattgtgtgcatttaataagaggatgacctttcagtttaatttcactatagaagaccatctggaaaatgaattaacacccattagagatggagctttgaccctggattcctcaaaagagctgtcagtctcagaaagtcaaaaaggagaagagagggacagaaaatgttctgcagaacaatttgacttgcctcaggatcacttgtgggaacataagtcaatggaaaatgcagctccctctcaagacacagacagtccactcagtgcagccagcagttcaaggaacttggagccacatggaaaacagccctccttgagagctgccaaagagcatgctatgcctaaagatttaaagaagatgttagaaaataaagtcatagaaacattaccaggtttccagcatgttaagttatcagtagtgaaaaccatcttgttgaaagagaacttccctggagaaaacatagtttcaaaaagcttttcttctcactctgatctgattacaggtgtttatgagggaggcttaaaaatctgggaatgtacctttgacctcctggcttatttcacaaaggccaaagtgaaatttgctgggaaaaaagtcttggatcttggttgtggatcaggtttactaggtataactgcattcaagggagggtccaaagaaattcactttcaagattataacagtatggtgattgatgaagtaaccttacctaatgtagtagctaactccactttggaagatgaagaaaatgatgtaaatgagccagatgtgaaaagatgcaggaaaccaaaagtaacacaactatataaatgccgatttttttctggtgagtggtctgagttttgtaagcttgtactaagtagtgaaaaactttttgtaaaatatgatctcattctcacctcagaaaccatttacaacccagattattatagtaatttgcaccagactttccttagactgttaagtaaaaatggacgtgtacttttggccagcaaagcacattattttggtgtaggtggaggtgttcatctctttcagaagtttgtagaagaaagagatgtttttaagaccagaatactcaaaataattgatgaaggattgaagaggttcataattgaaataacttttaagtttcctggttaattaacattcactgagtatccaaaatgaaataaacagaaggaccaaaaa

SEQ ID NO: 715 - DNA, 6111 bp, Homo sapiens
gcgctcccgcttgccgcagcctgcgtcgtctgccgccaccgcgcgccttcactgacctacaccaccgccgccgccgccgccgccgccgggctcgctggctggcccggtgcgggcggcggactcccgccggagaggactgccagcgccgccgccgccgccgcttcggcccgggcccgggccccgaccccgtcccgggccccagcgccggccgcccgcccggtcgggcgatgaagtgtcactatgaggcgctgggggtgcggcgcgacgccagcgaggaggagctcaagaaggcctatcggaagctggccctgaaatggcacccggataaaaatctggataatgccgcagaagcagctgaacaatttaaattaatccaagcagcatatgatgtgttgagtgaccctcaggaaagagcatggtatgataatcatagagaggccctacttaaaggtgggtttgatggcgaatatcaagatgacagcttagatttgctacgctatttcaccgttacctgttattctggttatggagatgatgaaaagggattttacacggtgtatcgtaatgtttttgaaatgattgccaaggaagaactagaatctgtgttagaggaagaggttgatgatttcccaacttttggagactcccagagtgactatgatacggtagtccatcctttctacgcttattggcagagtttctgcactcaaaagaattttgcatggaaggaagaatatgatacacgacaggcttcaaaccgctgggaaaaacgagccatggaaaaagaaaacaaaaagattcgggacaaagcaaggaaagagaagaatgagcttgtccgtcagctggtagctttcattcgtaaaagagataaaagagtgcaggcgcatcgaaaacttgtggaagaacagaatgcagagaaggcgaggaaagccgaagagatgaggcggcagcagaagctaaagcaggccaaactggtggagcagtacagagaacagagctggatgactatggccaatttggagaaagagctccaggagatggaggcacggtacgagaaggagtttggagatggatcggatgaaaatgaaatggaagaacatgaactcaaagatgaggaggatggtaaagacagtgatgaggccgaggacgctgagctctatgatgacctttactgcccagcatgtgacaaatcgttcaagacagaaaaggccatgaagaatcacgagaagtcaaagaagcatcgggaaatggtggccttgctaaaacaacagctggaggaggaagaagaaaatttttcaagacctcaaattgatgaaaatccattagatgacaattctgaggaagaaatggaagatgcaccaaaacaaaaagtcaagtatttgacatttcgatttatatttgctcttaggctttctaaaaaacagaagaaaaagaaacagaaaccagcacagaattatgatgacaatttcaatgtaaatggacctggagaaggagtaaaggttgatccagaagatactaacttaaatcaagacagtgccaaagaattggaagatagtccccaggaaaatgtcagtgtcacagagatcattaaaccatgtgatgatccaaaaagtgaagctaaaagtgttcctaaacccaaaggaaagaaaaccaaagatatgaaaaaacctgtcagagtacctgctgaaccacaaacaatgagtgttcttatcagctgtacaacctgccatagtgaatttccatctcggaataaactttttgaccatctaaaggccacaggtcatgcaagagcaccttcatcatcgtctttaaacagcgcaacaagtagtcaaagcaagaaagagaaacgtaaaaacagatagagattctgcctgtgcttttgtttgactgtctctagattttgaaaccaaaaaactgaactgaaatcatctaaagagttaaaatttcagtgatctgcaattaattacattgtggaagattattttttatcttgtaaaaacacttttttggtttaatatatatttttaaaacatttcactagtgattgaattctacttttgccatctgaattgacttgaatgtcttaaaacaggtaaatactgtaaagtgtgtattcttgatgtttattggctcatgtggacagaaatgtacagggagaattacattattttaacacacagaagtgcaactttctgctttattttctgaatttcacattacttttacttaatgcttttgtgttttgttaatacttcataatatgtgaaaaactcggatcttttaaaaagcatcatagatcatttttccatatgacactggttccgattttaaaaattatttttaaataaccgattattgattactgtattttttttctcaagaacagtgataggtagaaactaattgaacatttggtagtctttcaagaatagtgtctcttcaaggttttacttgatttaatttgatattttactggtttaccagtaaggtgtattgttcagttttttgctccgatttgaattgtggaggtggaagcaaattagtttacatggcatgtcctccctaggcacagtgacagctgtaaagtatgacggaacaaggtagcagatggtacagaatttatactatttaagaagagatgtggtgttcttcattgagtttttttcttcactattttcagaagtttttgttcttttttttttttccatcactcagtggagaaaagctttgttaatgaaagattttgtgatagagctgatgcttatacatctattctataacagtgatgaatattaacacaaaggaaatatggagaactgttataactgagtgttagaacagtcgtgtacattgatcagtattgagtccatttttaggatggattagtcagttcttttcattggtcttgaaagtaattttggctggtcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaagtaattttaaactcactggcttgaaatgtgtgctttctgtacaatgaagttattgctttccatatatccttgaatcttcagattaacgaaatgaacaaattttcggttacagatcagctctcaaacactaaagtccttaatggcaaggtcttttctgatagcttcatggatagtattgatgatcagatttcttctgtgttattgtcttaaaaataagcatttgaaccttaatttaaattcttttcttttccatttagagatatgtttttttctttaccttcatacctttctatttcttgctaatttctatcactaattccttataattgtccctgctccccttcttgatctcttcagggggaatactaggcagttttgtatcttctgatctcgtaccctgagacttcatctgaatgtgctctgccgccttcttatctgaactagatgaattggccataattatgaataggaatattaatgaaccagaggacatactagtcacatgttattatacactaaaaaataggaagtcatcttgaaaggcagttaatgtactgcaaatgtccctatgacttctttgctttctcttataccaaacatgcaggtatttaatttgtttaatgagggttgagtggagttatgtgtcgcttttattcggattgacgaaaatcaaccataattttcaagggatcttcatgggttgtgactggaagctgaccttagtcttgcgtctcatcctttatgatgttgagaaatcatctaatttctcagaactttttcttatctctaacacagttattaccataataatattgtctccatttatcatacaggatcattatgaaagtaaaatgaagtagtatatatgaaaatgctttttaaacacaaaagctttatacaaaatattgttgaatttaaataaggtaaatcttttttagtttatatatttgcagactatacatgttggattaaatgggcaattaagttttataggaatttgcttcctaagtctacttttgaagaggaaaacaggaacgtaccatatattttgctaagggtaaaatatttttggtgaattgcagacatttaatttcacttgtctgaggtaaaacaataaactaaaatacatgggcatgcatcttacactgatcttattagaggtcagtgctaagtacccatcttgattgaagttagctcagatgtggagattcatagaatgagggtccaggagaagaaagttaggggaaatctcattttctttctgtaattcattcagtggtgccaaagctgggggttccctacaatggctatttagactttccctgcttcaaaataagagcagtatccttagctctagccaagcatttttctaattcctgcctttggtcacaaagaaggaaaagcagagctgtgaatgagttagtggaggtcaagtcacatcagagttcatgacctagtgattgctggtgaagtaatattggaattttggtaccatgagaagacttataaaggatttcatcagaagttttcattttttctaaatcctcccctacaaaattttcagattggaaattactcttgtatttgtagaagattgtctctaaaattgtggtttaactcacgcaggaagtaaaattcctatagcaagacatagtttcattttagaggacccccaaaatcccgtgaattctctggtgatgattctagcctaaccttcaacataaaataatgaagagaacttttaaacttttttatgaattcctaaacattaccatttatgtggcagaagttctgttccctataatctgcaatgctgaagtatctctattcaattcccttccttatctgttaaatttaatgtctttatactaaaaatataggctcttgggattggagaggaaaaattagaggtgattttcagatttcttgttctatggaagaggaagctgagctcagggagatatgagctccacagccacagctggttaggggcggctgccagtagaacagggcagatgcctggactcccaactcagtaggccttctgttacacctcaaaatgtgttacatgggaagaaaaagattaagaaaaagcaagataattttgaagaaggacgagaggaagaggcatgaacttgtcctaacaatgtcaaagaatattttaaaggtataccagttaaagtagtgtgtggctggtgccagtagaggtcagtcaagggatccctgacgagaataaagagcccagaaacaggtccatgtttatatgggaacttgatttttgacagatacggcaagctctatggggaaaacaatatgtactaccttatacccttccccaaaaacaaagggattaaagacctaaatatgaagacaaaacttttaaatgagaatctataaggttattttcatgattttgcaaatgggaaggatttctttaaagcaagacacaaaagcatacacaggaaaaaatgatgcataaaaacatggcttctgtagaacaatagagactgtaaaagaacaagctacagacaaggaaatgtttgcaatgcatggaactgtcaaaggattcgtatctggaatacattaaagaagcaaaagaacctcatacaaaagtcattgagtaaatgacagccatgcattagaacagcaattctcaaaacttttggtctcaagatccctttacactcttcaaaagtgagaaccccaaagagttttcatgtatgtgggttaaatctattgatattttctgttagaatttaaaaattatgttaaaaaaataagaagaatgactatttttcaaaacaaaaaatgagaagagtggtattgttttacatttttacaaatctctttaacatttagcttaataaaagatagctggcctctc

SEQ ID NO: 716 - DNA, 1885 bp, Homo sapiens
cggcgtccccggggcccactcccgagcgcaggcgggcagccaggcgggcggcgcggcgcgggccggcaggaagcgtattctgggcacggggcgccgggcgggccggctgcgccgagcggcagtggtgggataccacccaaggcctcgcgcggcgccgcccgtcgaggggcgggcggcggcgtagccactgggccgtcgaagagcgcaggaggccggtgggccgggccgggccgcgcggcgcagccatgcctggctttacgtgctgcgtgccaggctgctacaacaactcgcaccgggacaaggcgctgcacttctacacgtttccaaaggacgctgagttgcggcgcctctggctcaagaacgtgtcgcgtgccggcgtcagtgggtgcttctccaccttccagcccaccacaggccaccgtctctgcagcgttcacttccagggcggccgcaagacctacacggtacgcgtccccaccatcttcccgctgcgcggcgtcaatgagcgcaaagtagcgcgcagacccgctggggccgcggccgcccgccgcaggcagcagcagcaacagcagcagcagcagcaacagcagcaacagcagcagcagcagcaacagcagcagcagcagcagcagcagcagcagtcctcaccctctgcctccactgcccagactgcccagctgcagccgaacctggtatctgcttccgcggccgtgcttctcacccttcaggccactgtagacagcagtcaggctccgggatccgtacagccggcgcccatcactcccactggagaagacgtgaagcccatcgatctcacagtgcaagtggagtttgcagccgcagagggcgcagccgctgcggccgccgcgtcggagttacaggctgctaccgcagggctggaggctgccgagtgccctatgggcccccagttggtggtggtaggggaagagggcttccctgatactggctccgaccattcgtactccttgtcgtcaggcaccacggaggaggagctcctgcgcaagctgaatgagcagcgggacatcctggctctgatggaagtgaagatgaaagagatgaaaggcagcattcgccacctgcgtctcactgaggccaagctgcgcgaagaactgcgtgagaaggatcggctgcttgccatggctgtcatccgcaagaagcacggaatgtgaactggtgccccggcagcctgctggactcccagaccccatccagccaggggaccgcaggccattgttgaactcctctatactcctgggcactggttgacagtactgaggcttaaggcagctggactctcttgctggtgacctggcatcctcaattgtttcctcctgaagtggaagctggggccttagactctgccctggtgacaccagcaattatgactttgtctacccttcctccccagttattgttgcagattctggttaagcagaggcttcagaaccactgaacttgaaacttaccctctagggatgcaggtgggatgtccagggactataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggttttt

SEQ ID NO: 717 - DNA, 4865 bp, Homo sapiens
acgcgcatggaacgcagcgaaggactatggcaggggagaacttcgctacgccgttccacgggcacgtgggccgcggcgccttcagcgacgtgtacgagcccgcggaggacacgtttctgcttttgaacgcgctggaggcagcggctgccgaactggcaggagtggaaatatgcctggaagtagggtcagggtctggtgtagtatctgcattcctagcctctatgataggccctcaggctttgtacatgtgcactgatatcaaccctgaggcagcagcttgtaccctagagacagcacgctgtaacaaagttcacattcaaccagttattacagatttggtcaaaggcttgctaccaagattgaccgaaaaagttgatcttctggtgtttaatcccccctatgtagtgactccacctcaagaggtaggaagtcacggaatagaggcagcttgggctggtggcaaaaatggtcgggaagtcatggacaggttttttcccctggttccagatctcctttcaccaaaaggattattctatttagttaccattaaagaaaacaacccagaagaaattttgaaaataatgaagacaaaaggtctgcaaggaaccactgcactttccagacaagcaggccaagaaactctttcagtcctcaagttcaccaagtcttagcatacagtgtgtgcccagaactactggaaactgaatgcatttagcatattttgaaactgaagtcattcattaggtaacaaggaattttatcagaaatttgtcattaaaaaaaggtagaaaggtggaacattccctttcagtcaggcctatagaattatttgcacaagtacaagtaaatatgtgtattatatttatagtttgcattttaaatataaaaattatgtatgaaatatttatttcagcattatgtggtaaggcaatggaattgatctggcaaatgtcttttttttcataccagtccataaaggcagtttgctttcagatggcagggccagcaacacaccttcattgtcgtatctccggtgtgtatcagctctccaactctatgtcataattcagttcatggggatcttgattacctttcccttccacaaaatattacactgattggttatatcgatgacattatgctgatttgacctagtgagcaagaagtaggaactacattagacttagtggaaagacatttgcatcagagggtaggaaataaatatgactacaattcaagggccttctaccttagtgaaattggtagggatccagtgacatggggcatgttaggatatttcttctacggtgaaggataagtacttgcatcttgctgctcttaaaaccaagaaagaggcacaatacttagtgggcctctttgggttttggaggcaacattttccaatttcattatgttataccagcctgtttaccaattgactcaaaaagctgctagttttgagtagggcccagaacaagaaaagagtctgcaacaggtccaggctgctgtgcaagctgctctgccacttgggtcatatgatccagcagatccagtggtgtttcagtggcagtggcagatagggatgctgtttgaagcttctggcaggtccctataggtgaatcttggtttaggattttagagcaaagccgtgccattaccaacaaataactagtctctttttgagaaacagctcttggcctgctactgggccttagtagagactgatacttaatgagtcaccaagttaccgtgcaacctgagcttcccatcatgaactggatgttatctgagccaccaacgcacaaagttggatatgcacagcaacactctgtcatcagatggaagtggtatacacatgattgggcctgagaggccctgaaggcacaaggaagttacatgaagaagtaggccaaatttccgtagtccccacttctgctacctgccttctctcttccagcctgcatcggtggcttcatggggacttccctgtgatcagctgacagagaaagagaagacttaggcctggtttacagagtgttctgtatgatatgcaggtaccaccctaaagtggatagctgcagcactacatctcacctctgggctaccttgaaggacagtggtgaagggaaatcctcctggtggacacaactttgagcagtccccctgttgactttgcttagaaggaaaaatagccagatattcaattatatgccaattcataggccgtggccagtggtttggctggatggtcagggagttcaatataactggaaaattggtgacaaagaaatttggagatgaagtatgtggatagacactgaatgggcaaaaagggtgaagatatttgtgccccatgtgaatgctcaccaaagggttagcaaaaaaggattttaataaagtggacaagataacctgttctgtggatactagtaggcctctttctccagccacacctgtcatcacccaattgtttcatgagcaaagtagccatggtgacaagaatagaggttatgcatgggctcagcaacgtggacttctactcaccaaggctgacctggccaaggctatctctgagtgcccagtctgccagcaacagagaccaacactgagcccctgatatgacaccattccccagggtcatcagtcagttgcctagtggcaggttcattacattgatccacctctatcattgaagggatagtgttttatccttactgaaatagatcttactctggatacagattcactttcccttcgcgcagggtgtctgctaaaactaccatccgtggacttacagaatgtctcatctatgaccatggtattccacacagcattacaagaaactcagttcacagcaaaagtgtggcagtgggcccatgatcatggaattttcttaccatgttccctactatcttgaatcaactggctacatagagcagtggaatggcattttgaagacagtaataacaccagctatatagcagtgccttgtagggctgggacaaggttctctagaagactgtctatgctctgaatcaacatccagtatatggtgcatttctcttatgactgggattcacaggtccaggaatcaaggggtcagaataggaaggacaccattcgctattagccctggtgacccactagcaaaatttttgcttcctgttcccatgacttatgcactgctggcctagaggtcttacatagggtggaatattttccactgagagacgcaatcatgatttaattgaactggaagtttaagactgctcctcagccatttggggcttcttatgcctctaactcaatagacaaatgagttacagtgctggctgggtgattgttcctgactaccaagtagaaactggactaccccgaatggtggtaaggtaaagtatgttgggaatacacaggattccttagggcatctcttagtgttatcatgccctgtgattaaggtcaatggaaaactacagcctaattcagacaggaccactaatgatccagacctttcaggaatgaaggtttgggtcaccaccaggtaagtaccatgaccagatgaagtgcttgctgaaggcaaagggaatacagaataaatggtggaataaatactagctttgatcatatgaccagttacagaaacacagactgtgattgtcataagtatgtcctccatattttgctataactacattttgtgtgtgtgtagctttgttttcttctcatttccttattctgtaacataagatgcattgattttatagcatagtgtttaaatattgttaatttttttaactggctccagtgttcaaccttgattaattttacatcatagtatttaagttatgggatatcaaggagagagtaaacatcacatgaagactttaccacctcttctgggaaacgggttaaagtgtttctggtggaatgctggattgttaatcgtgttagatggaattatgaccttgttgttgtctttatgtggcagttaagtatggtttaaagagatgtttatgggtgccaagttgacaagggtaaacttgtgatggttaattttatatgtcaacttgaataggccacagggtgccaaatatctgtttaaacattattctgaagtgtcttgagtgtgtttacagacaagatttgcatttgaactgggggactcagtaaaggagatagccatccccaaggtgggtggacatcatccagtttgttgagggcgtaaataaaataaaaggcagaggaaggaagaattccccccccttttttttcctgcctcattgtttgagctgtgacatctcatcttctgtcctcagatggatttacatcactggcttccctggttctcaagcctttggattcagactgaattataccacaggccttcctgggtctccagcttatagatgacagatcatgggacctcttagcctccataatcatgtaagccactttcttgtagtactggtaaaagatatattaaaccaatctataaaacagatagctatgaaagagaaaggtgacaggcacaagcctaggcaaatagagaagggttcctggacagcctctgacttgcctaggtcattgtgcacacgtggcttgcctgaatgaacatgcccactgtgaaagattccatttctcaacacatgtgcagtaagggaaataaatcaatgtggctcaaactaaccgcccacacatggggtggagccacaaggagtttgctccttatgcaggggagaagccgtgcctcttcagctcgtgtgtggtggcctggcattcaatttgtgaggtgtaaaacctgcatgaaggacccctctttttgtggagagctttccttttgcctaataaattctgccctcctcgcc

SEQ ID NO: 718 - DNA, 3847 bp, Homo sapiens
gaagctgcgctggggccgggctctgagaggaccggcgcagccgcggggagcctttgaggccctccctcggtgttttttcccagggcgtgggcttgccccgcgcgtgtctgtggagggcggaaacagcggaggggccagtctcctggcgaaggggcctaatccttgcccgccatgtccgggggcttcgagctgcagccgcgggacggcggtccccgggtggccctggcgcccggggagacggtgatcggccgcgggccgctgctgggaataacagacaagagagtatccagaagacatgccattcttgaggtggcaggtggtcagctgcgaatcaaaccgatacacacaaatccatgtttttaccagtcttcagagaagagtcagctcttaccattgaagccaaatctatggtgctatttgaatcctggagacagcttttctttgttagttgacaaatacattttccgcattctctctataccctctgaagtggaaatgcaatgtaccttaagaaacagtcaagtgcttgatgaagataatatattgaatgaaacaccaaaatcccccgtgattaatttacctcatgagactactggtgcctcacaactggaaggaagcacagaaatagccaagacccagatgactcccacaaatagtgtgtctttcctaggtgaaaatagagactgcaataagcagcagccaatccttgccgagaggaaaagaatccttccaacttggatgttagcagaacatttaagtgatcaaaacctttcagtaccagcaatcagtggaggtaatgtaatccagggaagtggaaaagaagaaatctgcaaagataaatcccagctaaacacaacccagcaaggaagaaggcaattaatttcatcaggaagttcagaaaatacatcagcagaacaagacacaggagaagagtgcaaaaatactgatcaggaagagtctaccatttcatccaaggaaatgccacaatcattttctgcaatcacattaagtaacacagagatgaataatattaagactaatgcacagagaaacaaacttccaatagaggaacttggtaaagtttctaaacataaaattgccactaaaagaacaccacataaagaagatgaggcaatgagctgttctgaaaattgttcgagtgcccagggcgactcacttcaggatgagtctcaagggtctcattctgagtccagctctaatccctccaatcctgaaactttgcatgcaaaggcaactgattcagttctacaaggttctgaaggaaacaaggtcaagaggacatcctgcatgtatggggcaaactgctataggaagaatcctgttcattttcaacattttagccatcctggtgatagtgattatggaggtgtacaaatcgtgggccaagatgagactgatgaccggcctgaatgtccctatggaccatcctgttataggaagaatccccagcacaagatagaatatagacataatacgcttccagtgagaaatgttttagatgaagataatgataatgttgggcaacccaatgagtatgacctgaacgacagctttctagatgatgaggaagaagactatgagccaacagatgaagattctgactgggaaccaggaaaggaagatgaagagaaggaagatgtggaagagcttttgaaagaagcaaaaaggtttatgaaaagaaaatagtaactaacttctgtagtcatatctgccttacatttactttttctttgtgggaaaacatttatgaactaaggaggtacttaagtgacagttattttccttcttttgatagttaatgacttttactactgactctttacaaatgagacattgaaacgtcagccttcagtataatagatggaattttttgttgccttgccttttctttcctacttaaagcatctggaaataggaagacagagaaggtagagtaaaaatggatattttttatgtactttgtatattggtaataaaaagtaaaagccataggttgcataaaactttggtctttttaaatttttttccaaagattatggagtactctgcaagtataaccaggcaaagtacatgaaaacatgcctcttttcattgttactgaagtaattctgtaagcagaaccaggctttaaaaaatgcagccattacataatggcgttttttttctagtaccttagatgtgagctttgcaatttcacttactacttttatccttcaaaacttgggaagattggttccaaatgggtactgaaaatagattcaactaggctgtagaagagaaatgttcaccatgtagggaatgttattttgtgttccacatctgcaatttactgtatgtttgaatttaaaagtaaaaaaactcaaaaaacttgaccttttttttcaaactaaagtcctagctgattattttaactctcagtgtgctgtctttatattaagaatagagaaacgacataactttctcaaatggcattagttttgccttagtttttttgacctcagatgaaagtagcaagttgtttgccagttgaaagttcaagattctggcctcccatatcaagaagaaaccacttattctccagttttacaaagtatctttctgtatttctgttctaaaactactttaagccctataatgctcttcatattacgtgactttgaattgttaaaatgtagtttagaatctttaataacagttgggttgtgtacacagagcaggagatatttattgaaatcataaatcactaagccaaaagaatctttgttaaatgctattattttctactctaaaggaacctaaaaatttatatcttaaaagatcaaaacatatttataataatattttctcattgctttaaaatatatctcccagtaattatacaatatttaatatttacttaaactggaacaagaataagataaacatttctctagactataacctattattctgatttttatctcttattgttatttgggaactatttttccccttataatgtccctttagccttggtagtataacaaatctacgaatgtaatatttaacttattctcatccctgccactaacttaatccttgaagtgttacataatctactcctaggtatatacccagaggaattgaaaacatttccacataaaaactgtacacaatgtcaatagaagcattattcttaacagccaaaaagtataaacacccaaagtctatcaactatcaactgggtgaatggataagcaaaacgtggtatatctgtgcaatggaatattatttggtcataaaaaggaataaagtactgatacatgctacaagatagatgaaccttgaaggcaagtaaaagaagccagacacaaaaggccacatactgtatgaactcatttatatgaaatttccaaaacaggcaaatccataaagacagaaagcaaatttgtggttgccagggacttggggaggaagaatggggagtgactgctaatgagtataggatttccttttgagtgataaaaatgttctaagattagatggcagtgatggttgcacaactctgtaaatatattacaaacaatgcattgtacactttcaaagggtagatttcattgcacgtgaactatatatttcaataaatctgtcacaaaaaagtaatgcaaagggtaataccagtcttttagaaggaaaaaaatatttaatatcaaaggatattcttcgtagtaatgtaatagttcatggtagctgcttttaacgatacagttttaatgcaactttcataatcatcctgaagacacttttgagtataactattgtataaataaatgtatagcttaattga

SEQ ID NO: 719 - DNA, 1432 bp, Homo sapiens
gaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacccctgctggtggctctgtcctctgttaggcaccacactggttggtcaacttggatgttcatcgaggctcattctggccttgctcagaagcccttctgatgctcttcagtgagggaggcactaccatttgaagtgaccccatgtcagtcacatggactggtctttagcaaagtccaaggctgcctgcttccacctaagtggtctctgttctacactttaatgtcaccctctacatcatcttacctagcccacccaaccttataaacatgataattgactactttcctgagctaaa

SEQ ID NO: 720 - DNA, 5586 bp, Homo sapiens
cgcggcttgcaaggcgcctgcgactcggtcccaggtcggcgggcggcgcacggcgggctcgcgcgggggccccggcgcgccgggcggcgcagtacgcagcgcgcggacccacgccacggccaggagcccagagcagcgcggccacactgcccaggggtcggccctcggccccggcgctcggagcgcggcggctgcctgggctttaatggctgctccgcggagcagcgcctagggctggaaggcggctgcggctcaggaagtcacccgagcaagcctccttcggggccggccgcacccgccgcggcgcgctccatgggggcgcgctccccccgggcggcccgctgacccgggacgccggggcccgctcgctcgccggccgcgcgtcccggccatgaactgagcccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctgcaccatgaactaccagcagcagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagggaatgtcactagtgcatctgggtctcagatggcaagcggcatcagcctggtctccttcaacagccgacccgacggcatgcaccagcgctcctactcagtctccagtgccgaccagtggagtgaggctacggtcattgcaaactcggccatcagcagtgacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatttgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaa

SEQ ID NO: 721 - DNA, 2678 bp, Homo sapiens
attctaaatgcaaagctagactgagcaagggaagtgacaggaaatggagctggggagacaaaaatgtggataacaacaaaagaatttcaacaggtaaaaaaatgagtcaaacatctctcaaacagaaaaagaatgagcctggaatgaggtcctcaaaagagagtctagaagcagaaaaaagaaaggaatctgacaaaacaggagttcgtctgagcaatcagggatcacaagaatcatcactgcggaagacagactctcgagggtaccttgtgcgcagtcaatggtctagaatatcccggagcccatccaccaaggctccatccatagatgagcctagaagcaggaacaccagtgctaagctccccagcagctccacgagctcccggactccatccacctccccaagcctgcatgactcctcaccgccgccgctgtccgggcagccctcgctccagccacccgcgtcgccccagctgccccggtcgctggactcgcggcctcccacgcccccagagcccgatcctggctcccggcgcagcaccaaaatgcaagagaatccggaggcctgggcccaaggcatcgtgcgggaaatccgccagacccgggactcgcagccgctggaatattcgcgcacgtcccccaccgagtggaagtcctccagccagcgcagggggatctaccccgcctccacccagctggaccgcaactctctgtccgagcagcagcagcagcagcgggaggacgaggacgactacgaggctgcctactgggcatccatgaggtcgttctacgagaagaacccgagctgctcgcgcccctggccgcccaaacccaagaacgccatcaccattgctctctcatcctgcgcgctcttcaacatggtggacggcaggaaaatctacgagcaagagggtctggaaaagtacatggagtatcagctcaccaatgagaacgtcatcctgaccccgggcccggcgttccgcttcgtcaaggcactacagtatgtcaatgctagactccgtgatctatatcctgatgaacaggacttatttgatattgtactgatgactaataaccatgcccaagtgggagtgcggcttataaacagcgtcaatcactacggcttactgattgaccgcttctgtctgaccgggggaaaagaccccattggctatttgaaggcatatcttaccaacttgtatattgctgcagattctgaaaaagtgcaagaggcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaagtaagcctcttgctcagggtcccctaaaaggctttctggaagatttaggcagactgcaaaagaagttctatgccaaaaatgaacggttactttgtcctatcaggacctacctggttacagctaggagtgcagccagttcaggcgcccgtgtgctgaagacccttcgacgctggggtctagagatagacgaagctcttttccttgctggagcccccaaaagtcccatcttggtgaagatccggccccacatcttctttgatgaccacatgttccacattgaaggggcacagaggttaggttccatcgcagcttatggctttaataaaaaattcagtagttaggggcagggaggagaaataaagtggtgatagtctggtgttacagaagccacttcttttggctctctaggataattagataggtatttcagaaaattggaccttaaaactttgcttctttggaaaggttttctcctgattttttggaaaaccttttgaaccctcaagttaccatcaaactacttctctttgaactaccaatactgttgaatgccattacacctatctctgtgtaagtcataatgatgactctttaggataagtttagaacttgaatatttgcatgcttaaggcactgttttagaagcttacttagttttataaacactgctcatttttggatgtttgtagataacaatgaattgttacccatcagcattgtagaatagtgtcttcaaaggtagaaggagtatggttaagcacactcttgaaaactggagctttgtattctgtgactgctatggctagctttgtaaccaaagcaaaatgagaatttcactctacctgcatgagtataacaattttgatactgctcatttagaaataaatcatctggttgttcctccagggtactttctaagataagccttaaacagaaacccctaagaaaggttctctgaaaattatttggtgggttaaatgcctctgatccacagagtttcatatttgaagtctccggctttgggcctggcaggctggcacatccatatttgtatggaaaaaaaaaaaaaagaccctacgctaccacttcaaaaagtgacatgaagtgtagtatcctggcccttcattgtcattctctcatgatttttgttttgttttcaacaaaaattggttggtcattaaatatatcatatgttaggcacagtgacctggttattttcacatgttacttcattttcttatcaaattaaatgtttgtgacatagt

SEQ ID NO: 722 - DNA, 1856 bp, Homo sapiens
cacccgctcagctcgaccgcggagggcagctccaaaggggaccccaaaggtgcccacgcggggctggggcctcctgggcgtcgttgggagcggccactaccggcccgggtccgagctgtcagcctctccaaagcctgcgcgagaggagccgggacacgcctagcgcgggctccaggtggctgaccacgtccacgaccacatctgcctctaaactggaattcggttgctgacccagccccagcctcggctttcttgtcagcaccagggggcacagaacaccgtctcagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggggccggcagatggtggagcccggaaaccgagcgctgtggagcgcctggaggccgacaaggccaagtacgtcaagagcctgcacgtggccaacacccgccaggagcctgtgcagcccctgctgtccaaacagccgctctttagccctgagactcgccgcacagtgctcacgcccagccgccgagccctgcctggcccctgccgacggccccagctggacctggacatcctcagcagcctcatcgacttgtgtgacagccccgtgtcccctgccgaggccagccgcactcctggacgggccgagggagccggccgtcctcccccagccacccctccgcgaccgccgcccagtacctctgcggtccgccgggtggacgtccgccccctgcccgcctcgcctgcccggccctgcccatcacccggccctgccgccgcctccagcccagcccggccgccgggtttgcaacgctccaagtcggacttgagcgagcgcttttctagggcagccgctgatctcgagcgcttttttaacttctgcggcctggacccggaggaggcgagagggttgggtgtggcccacctggcacgggccagctcggatatcgtgtccctggcagggcccagtgctgggccgggcagctctgaagggggctgctcccgccgcagctcggtgactgttgaggagcgggcccgggagcgcgttccctatggcgtgtcggtggtggagcgcaatgcccgcgtgatcaagtggttgtatgggctaaggcaggctcgggagagcccagcagctgaaggctaggcgccactgggcctggaattcgccacaggacggatcttacagaggcaagtggtccctggacctctcttgcatccattctctagacggccgtgtcagaggctccaccctgttgtgaacttggtatggaggcaaaggcttagaggctggaccagcattgttgggcaaggactgactctccaagggttttgttcttggctttggacacctgagaaccccctcctcccctcccccaatacaaggtttttgacatgagtgtactcctgcttagttcctcttgtggggctgcatttgcggtgctttgccctccccactgtgagtgaggggccaagggatctcctcaatcctgtctccccagcggctctgtttcctccttccttccttggcctctgtcctttgctgacttcctcttccttacccagcagaactcaccctggggtcggggcagtggggaggggcctatccactgctcttcctagtccttggcagctggcctaggtgggcagactataggagggactggttaggagtctgcattgctttgacttccctctccttggttaataaacacaaatgcttgtttctcaagg

SEQ ID NO: 723 - DNA, 1335 bp, Homo sapiens
tgatggtcaacatgtcagcaccagccatctgcctcgtgccctgggttgacctgggtttaggagaggatcccacatctgggcagaaagaccccaccccctgaaaaaagagcaaacagatttcttgcatctttcgttctatgtggctctcagaacattaaatccaggagtgctttaggaattgggtgcacagtgcctgccaccgaagaggagaaaatgaggtgtggaaacgtgcaaaccgtttgtgagggtctcagcgaggcctcttcatgccccaggcaccaccagctccccctccccagctcgttcccagccaggaccctcagctgtcctctcaggccccctgcgacagctgaagagtgtgcgggggaggggactaggggtccgggcggcgctggtcacaccctcgttgctctcactcagggcccccactcccagcccctccccccccaagaggctcggcactattttgggtggtgtcgaccccgcccccacctcctatcgagccctggctctccgggcagctggaggggtcgcgctgcgcctgttggggctgcacctcggaccagggcttctgctgcatctgcagccatgtcgggccgctcagtgccacatgcccacccggccaccgccgagtacgaatttgccaacccgagccgcctgggtgagcagcgcttcggagaaggcctcctgccagaagagatcctgacccccacactctaccatggctactatgtccggcctcgggccgccccagctggggagggcagcagggcaggggcctccgagcttaggctcagtgagggcaagttccaggcatttctggatgtgagccactttaccccagacgaggtgactgtgaggactgtggataacctgctggaggtgtctgcccggcacccccagcgcctggaccgccacggcttcgtgtcccgagagttctgccgcacctatgtcctgcctgctgatgtcgacccctggcgagtccgagctgctctctcccatgatggcatcttaaacctggaagcacctcggggtggccgacatttggacacagaggtcaatgaggtctacatctccctgctccctgcgcctcctgatccagaggaagaggaggaggcagccatagttgagccctgattgccacagacccagcacccagcaaatccctctctacctcccaaggtgatatgggcagctgcccaccactccagaggtagcagcatccttgggggaagggaaaggtgcatggtccacaatgtatggtttggtcccatgggacatgtcatagccttggtttagttttgggtggagctgaataaacccaaatctcagggc

SEQ ID NO: 724 - DNA, 1349 bp, Homo sapiens
agtggcagcggcggggacggggtcagtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctgatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtgctgggcctcgtgcgggtcccgctgtacacccagaaggaccgagtcggaggcttccccaacttcctgagcaacgccttcgtgagcacggctaagtgccagctcctctttgccctcaaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattgtcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagctgctctgtgtgtttctca

SEQ ID NO: 725 - DNA, 3868 bp, Homo sapiens
gggccgtgctcttgctcccgccgcctggcagcctcacgctcggctccagcggccaagagccggagaaagtcctgctggtgggcggccgcggggctgagggcgtccggcatcccggggccgctccggcccgggcggcgagagtgcccggcggtccatgcatccgccgccgcccgccgccgcgatggatttcagtcagaacagcctgttcggttacatggaggacctgcaggagctcaccatcatcgagaggccggtccgccggagcctcaagacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagagaagccctgcatgttgcaggagtggaaatgcagttaacggctgcgatgtcatttctgaccattctgcaggacgaatcagtgtcaattcatgcatatacccactcattcctccaagtcattctcctgcatctggagcacagggacacaggtgtcagcaatgcatggctggaaactcttctgtctgttatagaagtattgccaaaagaaaccctacggcatgagattttgaatccacttgtttccaaggcacaactttcccaaacagtccagtctcgtttagttagttgtaaaattttaggaaaattgaccaacaaatttgatgcccacaccattaagcgagaaatacttcctctggtaaaatcactctgtcaagatgtagaatatgaagttcgatcttgtatgtgtcggcaattagaaaatatagcccagggcattgggacagaacttacaaaaagtgtggtgctccctgaattaatagaactttctagggatgaaggcagcagtgtacgacttgcagcttttgaaactttggttaatctgcttgatatatttgatacagatgacagaagtcaaactatacttcccttagtgaaatcattttgtgaaaaatctttcaaagcagatgaatcaattcttatttctttatctttccatttaggaaaactatgtcatggactatatggaattttcactccagatcagcacttgagatttttggaattttataagaaactttgtacattgggtttgcaacaagaaaatggacacaatgaaaaccagattccaccccaaatcctagagcaggagaagaaatatatttcagtacggaagaactgtgcttataactttccggccatgattgtttttgttgatcctaaaaacttccacatggaactctattctacattcttctgcctttgccatgaccctgaagtaccagtcagatacactattgctatttgcttttatgaagtatctaagcttctgaattctggagtatatttaatacataaagaactaataacattattacaagatgaatcactggaggtactagatgctcttatagatcatcttccagaaatcttggaacttatgtctactggtggagaaagcagtgttcaagaaaataagttatcttctctgcctgacttgattccagcactcacagctgctgaacagcgagctgcagcctctttaaaatggagaactcatgagaagctacttcagaaatatgcctgcctgccacatgtcatatcaagcgatcagatttattaccgtttcttacaaagaatgttcacaatcatgatgacaaataatgttttacctgtccaaaaggcggcttcacgaactctatgcatttttctgcgttataatcgtaaacaagaacagagacatgaggtcattcaaaaattaattgaacaattgggccaaggaaaaagttactggaatagacttcgatttttggatacctgtgaatttattatagagatattttcaaaatcatttttctgtaaatatttctttctacctgctattgaactgacacatgatccagtagcaaatgtgagaatgaaactttgctacctgttgcccaaagtgaaatctactctgaagattcctgctgataagcatctacttcagcagttagaaatgtgtgtgaggaaactcctgtgtcaagaaaaagataaagatgttctggctattgtaaaaagaactgtattagagttggacagaatggaaatgtctatggatgcttttcagaaaaagttttatgagaaagatttgttggatcaagagaaagaaagagaagaactacttcttttggaaatggaacaattagagaaagaaaagcaacagaatgatggaaggcccatgagtgataaaatgtttgaaaagaaacgtagagacactaagacaccaacgcaaagtctgcccaagaacatccccatttctgttcctggaccctcttctgtcaccccatcgacaagtaaagaaatcaagaaatccaaactgattcgaagccagtcttttaataatcaagcttttcatgcaaaatatggcaacttagagaaatgtgctagtaaaagttctacaacaggatatacaacttctgtctcagggttaggaaagacttctgtgctttcactagctgatgattcattccggactcgtaatgccagtagcgttccatcttccttttctcctaatactcccttaccgagtacttcccgtgggacaggtaactcagttgaccccaagagcagtggaagtaaagatacacaaccacggaaggctaccttaaaatccagaaaatccaatccttaaatcaactgcttgatgaaggaggcaaaacaaaggcagcaggagataatgtgattggtacacaaaagctaaagcagtggctggggctttgtttttaaattttgggtttttttttttgttgttgttaatgagcagaaagagagacataatgacagctgatgttaaacttttcatatttcaaattagattccctaggaggtataatatatatttcttgagtaataatgtggttacggaattccaatgttatagtgaagtgtaatgaaaaacatctctaggaatgtgctttaaccactgctgcaaaagagacaagtctgcatttatttgtgcaggaaaccagccatttaattgttctagagttttagcatttaaaaatcgtatgaaagtctacatcagctgaattgtcctagcttgataagcacttggagggggacttggaaggtgagaaagatactgcattttctcatgagtctccaagcccacttgaaaagtcacactgaaaggatgcaaatagccgtctgcgattttggcggccctccggattgtggtgacaatatgttgtacccggacattcccaaatttaaatttggcagtgaaaattccacaaagatttctggtaactttgagctataaataccttaaaaataatagattgatgattttctttatttcctagagaatttattttataaatactttgtttacattttagattgtacttgtctttatttaaaatgatgaatctagtctgaatcagctgttattccaagctatcatgcttaagctatgtcaacagcatttatttgtactaatgctaatatttccatcaaaatttgcctgtggaatatatacagttcttaattttaaactgtcagttcttgagatataccgtgtgaagctattgtcagcttctctatttcaaaatgcaatcagcatataactatattgatattagaagatatttgttttttaaaatatattgatgtatgataaagatgatctaatttgtgaatgcatatgtatgtgtggttactttttataatgtgaaataatgaataatgaatttactcaaaataaaacataggttaatgagat

SEQ ID NO: 726 - DNA, 1169 bp, Homo sapiens
catttgggcaacggacgaattaagcggcgtggagatgcggcagccactgagctggggccgctggcgcgcgatgcttgcccgaacctacggccccgggccttcggcgggttaccgctgggcctcgggcgcacagggttacgtgcggaatccgccagttggagcgtgcgatctgcagggcgagctggacagattcgggggcatctcggtgcgcctggcgcggctcgatgcgctggaccgcctggacgctgccgccttccagaagggcttgcaggctgcagtacagcaatggcgatcagaaggtagaacagctgtatggctgcacattcccatcctccaaagccgatttattgcccctgctgcttccctgggcttctgctttcaccacgcagaatcggattcatcaacgttgactctgtggctgagagaagggcccagcagattaccaggatatgcttcacatcaagtaggagttgcaggagctgtatttgatgaaagtactagaaaaatactggttgtacaagatcgaaataaattgaaaaatatgtggaagtttccaggaggcctgtcagagcctgaagaagatattggagacacagcggttcgagaagtttttgaagagactggtataaaatcagaattcaggtccgtcctgagtattcggcaacagcacacaaatcctggagcttttgggaagtcagatatgtatatcatctgccgcctaaagccatattcattcaccataaatttttgccaggaagaatgcttaagatgtgagtggatggatctcaatgacctggcgaagactgaaaatacaactcccatcaccagcagagttgctaggctgctgctgtatgggtacagagaagggtttgacaaaattgacctgactgtggaagaacttccagcagtttacacaggactgttttataaactctatcataaggaactgccagagaattataaaactatgaaaggaattgattaaattcacatttatatgtttagaaacatgtagactaacgaatgacataagaaatagtggacattttggattgattaaacatctgactgtgattttctaatgtatatgatttccatgaagaaattttgtttctaaacatgcacattttaaaagcctcttttcgaataaagcaaatgcgtgaaaaaga

SEQ ID NO: 727 - DNA, 2081 bp, Homo sapiens
gtgagccgagattgcaccactgcactccagcctgggtgacagagcgagactccatctaaaaaaaataaataaacatgggagaaacctggaagaatatttgctcaactgtgaggcatggttggtggctaagggatcacagaatggcaggcctgcctattcctcctgagatcgttaaggaggctgaggtgccgcaggctgcgctgggcgtcccagcccaggggacaggggacaatggccacacgcctgtggaggaggaggtcgggggcatcccagtaccagcaccggggctcctgcaggtcacggagaggaggcagcctctgagcagcgtctcctctctggaggtccacttcgacctcctggacctcactgagctcaccgacatgtcggaccaggagctggccgaggtctttgctgactcggacgacgagaacctcaacaccgagtccccagcaggtctgcacccgctgccccgggccggctacctgcgctccccttcctggacgaggacaagggctgagcagagccacgagaagcagcccctaggcgaccccgagcggcaggccacagtcctggacacgtttctcactgtggagaggccccaggaggactagaccatctccacctgccccagctcctgcagggatggggtccgaacacgatggcagatctgggcagtgctgacccagcagacacacttcacccgcccacgaggctccagccgtcacctcctgacacacaccctgggggcagctctctgccagccccgagaccggccttgtctgctgggcacgggtcttcgcctcacttggagaccagccggctttcctgggggacacacggggcccccggatgcctctgggagccccagcacaagcacagcccagtggccttacgtccagctcgttcctgggccccgagtcaggaagacagcgtcacggagtcactgccaggaacgtgctgaggaatggagtggcccacggcggccttggggtgaaggggacccaggcctgtgacagccactccaggaactcctgggggtgctccaacctccgcgttttcctgtgctgccaagctcagaagccagaggcgggtttggtagtggctaatgggacaatgtgctgtccagcaaagcacacatggagaagcggccccaaaattcccaccttgatttccatcctgccccttcttctactccacggaggcgctgtctcactagggtcccctccccaaggctcagctctaagacctgcacctgcttctcttggcccctgcgtgacagacaagtccattccctccttagctcagaacaccaaatatcaccagactgcctaagagacttgatgacacctcccggaatgctctcggggtggggttcacctctccttgtcctgcacccactgctaggccacattctcgtttctgctcacatcccattgcccggctacaaggcctgcccacggcccttaaacttgctgggcaggtttggagcccatgggaccccgtgggtctctgtccaggagcagcagaggaggctgacaggccctgctccctctgctctgggggtgtctgggagccccagctcacaccctcccaatgcttatatgctgaagctcacagaatgggcttcttgcctgacagcaagtcaaagaatgagtttaatatcaaagtgtaagcttactttccatccccaagccagcctgccccctgccccatttcccatgagcacacttctggggaaggaaaacaggctcctggccttcactctcagcagagctttggagatgccccaggcatgccctgagctccttctgtgtacctgctcccacttctgagccacccgctgcccctccgcactgctggcaaacccagttcctgcctcagccaggtctccttccctggtttccagtcacacagagcccagcagctttctctttcagtcccataagggcagccttgtgtccctggccacacttccacccgccagggtcttcctccccatctttccatccttcctgctgagcttccacagagctcgtttgcaaacagggggattaaagcatcactgcgcattcgaaggcctg

SEQ ID NO: 728 - DNA, 3769 bp, Homo sapiens
gtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagtttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagtgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggcttttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcatgatctcagctcattgcagcctccacctcctgggttcaagtgattctgcctcagccccttgatcagctgggattacatgcatgtaccaccacacccagctaattcttgtatttttagtagagatggagacagagtttcaccatgtaggccaggctagtctcaaactcctgacctcaagtgatccacaagcctgggcctcccaaagtgctgggattacaggcatgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacacctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttacaaaaattgcgcacttatatgtatgtaccatgacataactaa

SEQ ID NO: 729 - DNA, 3334 bp, Homo sapiens
agcactctttcagtcagcatcgttcctggatttttttctcactgctgagcagcataaaagggtggggccgcttccctgcagcagaggcagaggcggcggcggcagcggctgcagcatcattcgcgggcagcggcggagaccgagagctgcagaaaagggtggggtcgcttcccaggagaagaggcggtggcggcggcggctgcggcatcctcgcgggcagcggcggaggcagcaatgctcggtctccgctggaggtgatggcctcccagccctgctaggtggccggctgcactaggacgccggcaggaaggagactcgagcccggtccgcggaccctgcggccacaccgcccggcccctcctctgcgccatggcttaagcctgtagccacctctcctcacgtcgcctcgctcgaccgaggtctgtgcgccgccgcagccgcagggaggggcgcgtcccagacaccctcgccggggactcgggaacgccgtgcgtctcacccttcggcgctcgcagcagactgcgctcccaaaggcgtttgcgaccggtaatcgagggactctacagactctcctaggacagctctccccgggtgctcgctgagggaggagggcgaactagctccggctgatcgggggtagaaaacggtgggaaccacattggccggtcaggatcggaggctgaaggaagattatagagacttgctttagaaccacaagaagaaagaggaggccggcttttcagctagcatcatggcgtggccgtgcatcacgagggcctgctgcatcgcccgcttctggaaccagttggacaaagcggacatcgctgtgccgctggttttcaccaagtactcggaggccaccgagcacccgggcgccccgccgcagccaccgccgccgcagcagcaggcgcagccggcgctcgcgcccccctcggcgcgcgcggttgccatagagacgcagccagcccagggcgagttggatgcagttgcccgggcaacggggccagcgcctgggcctaccggcgagcgcgagccggcggcgggccccggccggagcgggccgggcccgggcctgggctccggctccacctccggccccgcggactcggtgatgcggcaggattaccgagcctggaaggtgcagcggcccgagcccagctgccggccgcgcagcgaataccagccctccgacgctcccttcgagcgcgagacccagtaccagaaggacttccgcgcctggccgctgccgcgccgcggggaccacccgtggatccccaagcccgtgcagatctctgcggcctcccaggcgtcggcgcccattctcggggcgcccaagcgccggccgcagagccaggagcgctggccagtgcaggccgccgctgaggcccgggagcaggaggcggcccccggcggagcgggtggcctggcggccggaaaggcgtccggggcggacgagcgcgacacgcgcaggaaggccgggcctgcctggattgtgcgccgcgccgagggcctggggcacgagcagacgccgctgcccgcggcccaggcccaggtccaggccaccggccccgaggctggcagggggcgcgccgcggcggacgccctcaaccggcaaatccgcgaggaggtggcgagtgcagtgagcagctcctacaggaatgaattcagggcatggacggacatcaagcctgtgaaaccaataaaggccaagccccagtacaagcccccagatgataagatggttcatgagaccagctacagtgctcagttcaaaggagaggccagcaagccaacaacagctgacaataaggtcattgatcgcagaagaatacgcagcctctacagcgaacccttcaaggaacccccaaaggtggaaaaacctagtgttcagagttccaaaccaaaaaagacctcagcgagccataagcccacgaggaaggccaaagacaagcaggcggtgtcaggccaggctgccaagaaaaagagcgcggagggcccgagtaccaccaagccagacgacaaggagcaaagcaaagagatgaacaataaactggctgaggcgaaagagagcctggctcaacccgtcagtgattcaagtaagactcaaggtcctgtagccacagagccagacaaggatcaaggttctgtggtcccaggccttctgaaaggtcaaggtcctatggtgcaagagcctctgaagaagcaaggttctgtggtcccagggcctccaaaggatctaggtcccatgatcccattaccagtcaaggatcaagatcacacggtccctgagcctttaaagaatgaaagccctgttatctcagcaccagtcaaggaccaaggtccctcggtcccagttcctccaaagaatcaaagtcctatggttccagcaaaagttaaggatcaaggctctgtggtaccagagtctctaaaggatcaaggtcctaggattcctgagcctgtgaagaatcaagctcctatggtcccagcacctgtcaaggatgaaggtcccatggtctcagcatctgtcaaggatcaaggtcccatggtctcagcacctgtcaaggatcaaggtcccatagtcccagcacctgtcaagggtgaaggtcccatagtcccagcacctgtcaaggatgaaggtcccatggtctcagcacctatcaaggatcaagatcccatggtcccagagcatccgaaggatgaaagtgccatggccacagcacccataaagaatcaaggttccatggtctctgagcctgtaaagaatcaaggtttagtggtctcagggccagtcaaggatcaagatgttgtagtcccagagcatgcaaaggttcacgattctgcagttgtggcacctgtaaagaatcaaggtcctgtggtccccgagtccgtgaagaatcaagaccccattctcccagtactagttaaggatcaaggccccacagtcctacagcctccaaagaatcaaggtcgtatagtccctgaacctctgaagaatcaagttcctatagtcccagtgcctctgaaggatcaagatcctctggtgccagtaccagcaaaggaccaaggtcctgcagtccctgaacctctgaagactcaaggtcccagggaccctcagctacctactgtctcacctctaccccgagtcatgatcccaactgccccccatacggaatacattgagagctccccttgacactcaccccttgacacaccaatgaaggagctgacagtgagagtgctcccctcccaggggcagtgaagacacatatttaatctgcatgaaacatgtacagtagtcttgctggaatctaataaaaatggtccctctggctca

SEQ ID NO: 730 - DNA, 1480 bp, Homo sapiens
gccatcttggggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaatata

SEQ ID NO: 731 - DNA, 1444 bp, Homo sapiens
aaccattgtgatggtctagataagtgtacatgcttaggccttctgaagcagcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttcaggttttgtcacaaggatccttgttagaaagtccaagttacacagtttgtgtctctgagccagataaagatgatgattttctttctctgaactttcccaggaaactttggaaaatagtggaaagtgaccaattcaagtctatttcatgggatgagaatggaacttgcatagtgattaatgaagaactcttcaagaaagaaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaagttaaagttctattataatccaaatttcaagcgtggctatccccaacttttagtaagagtgaagagaagaattggtgttaaaaatgcttcacctatatctactttattcaacgaagatttcaacaagaagcattttagagcaggggctaacatggagaatcataattctgccttagctgctgaagctagtgaagaaagtttattttcagcctctaaaaatttaaatatgcctctaacaagggaatcttctgtcagacagataattgcaaattcatctgtccccattagaagtggtttccctcctccttcaccttcaacctcagttggaccatcagaacaaattgcaacagatcaacatgctattttaaatcagttgaccactattcatatgcactctcatagtacctacatgcaagcaaggggccacattgtgaattttattacaaccacaacttctcaataccacatcatatctcccttacaaaatggttattttgggctgacagtggaaccatctgctgttcccacacgatatcctctggtatcagtcaatgaggctccatatcgtaacatgctaccagcaggcaacccgtggttgcaaatgcctacgatcgctgatagatcagctgcccctcattccaggctagctcttcaaccatcaccactggacaaatatcaccctaattacaactgatctgccattaaaagaggaccagattatgaatgacaacagagactaacatttacattgacaaaaaaccctaaaaatttctgcaattatcttattgaacaataaaattgcatgtttacttcta

SEQ ID NO: 732 - DNA, 5718 bp, Homo sapiens
accgcaaagaagtcgcgctttgattgggccgctgtcaggtgtcgctgcctgcaggttcggctgcgcgagcggagggaggcgggactcaagagtagccttcctcgaggacctgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctctgttatctcaggtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgagctcttgtttgtcccggccgtaaaacgattttctgtgtcgtttgcaaagcatccgactaacgggtttgaagggtgttccatggtgcctaccatctaccctctggaaacactgcataatgccctttccctacgtcaagtgagtgaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggtacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaatggtggtgatgga

SEQ ID NO: 733 - DNA, 3715 bp, Homo sapiens
attctatgagacagagtctcactctgtcgcccacgctggagtacagtggtgcaatcttggcttactgcaacctccgtctcctgggttcaagcaattcttctgcctcagcttccggagtagctggaacgtgtgagccaccacccctggctaatttttgtatttttagtagagacaggctggtctcgaactcctgacttccggtgatctgcccacctcagcctcccaaattgttggtattacaggcgtgagccaccgcacctggcctctatttatttatttattttgagatggggtcttgatatgaattcctagactcatgcttctcatgcttgctaccacccagtcctgcctcctgcacagcagtttccactaaagtcacccctttacgagaggcatcttttttttttttttgagatggtgtctcactctgtcgcccaggctggagtgcaatggcatgatctcagctcactgcaagctccacctcctgggttcaagtgattctcctgcttcagcctcccgagtagctgggactacaggcacccgccaccattcccggctaattttttgtatctttagtagagacggggtttcaccatgttagccaggatggtctcgatctcctgacttcgtgatccacccgcctcggcctcccaaagtgttgggattacaggcatgagccactgtacctggcctactagaggcatcttaaaacacatctcctgtgtctccattccaaagcgcatctttgtctacactcctggggtcctcccacgtcagcctcccaaagtgctgggattacagtcatgagccactgtgcccggccccaccaaattgttttctaacctgcttttttcttgaggaatcttctgcagcacatgactcacatgtagagccccttgtttcttgaggccttcatacccgtcagctcatctaaaagtcactcctgaggagtaagggcaaggggcattgggagaggtcaggcagccctgggaagcctcccagcgtgtgtcccaggaggcctgctgcctgcagacactgctcccagacgcagcggcctcggccatcagagcgtgtcccacgatgaggtggcaacttccctgaagggcttgctctcacccaggggtgtggttctccgtgtgcacacagatagatagttctacgtttgccatataccatttatatgcctcacacagattaacccactttcatttcaaaaagacctcctgtcatcgtgcccattgtacagatgaggacactgagacacggaatcctagtgacctgtgcaaggtcacacagctgggaagggtgagggaagcgtctgtgaacccagcaggcccagcccctgagtctaggctccgctcggcagctgtcatgggagcagagtccgagaagcactgcaggcacctgctctagggggagagaggtggaggtggcaggtagagagaggacgacccctgggagctgagacgatgccagcctcacacggacaggctgggtgacctcaggcaagtcgcttcccatttgggaccccaaggacccttctgcagacccagctgggggtccccgatgagactggctctcagagtccctgtgagtcccgtcagctgaggccagtaatgtcctggcaccatcactggacatggtttgctctcccatggaggggcaggtgtagcagccaaaagcgatcctgagctctgggcctctgaaccctgctctgccagctactgtgggtgtctctacccgctctgtgtctcagttccctttcctgaaaagaggggatagtaaaaactaaccctcaaggtgtttattaccaatgcccttcatggaggaatccgctgctccaggcccttgccagcagctgcacagctgggcctggggacctgggtgtgggtctgttgaaccttggcccaccctggggctgtggtcggcctggacgtgtaggtgtggaggtgcatatttattatggcaattttctgacaggtaacagagtgtggggctctcttctgaatggggctcgtggaggccgtgggtcaaaagccctaattttgtagtgagggctaaaaggcttcacaagggaaagggcctggctggggctatgggccggtgccgaccccccctctcccactttgtttgcagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtc

SEQ ID NO: 734 - DNA, 1614 bp, Homo sapiens
gcggcggcggcgggcgcggcgcgatgtgcgagcgggcggcgcgcctgtgcagggccggcgcgcacaggctgctccgggagccgccgcagcagggccgggcgctgggcgggctgctgcgctgggtgggcgccaggatgggcgagccccgggagtcgctggcccccgccgcccccgcggaccccggcccagcctcgccgcgcgggggcaccgccgtcatcctggacattttccgccgtgcggacaaaaatgatgatgggaagctgtccttggaggaattccagctcttctttgcagatggcgtccttaatgagaaagaactggaggatctctttcacacgattgactctgacaacaccaaccatgtggacaccaaggagctgtgtgattactttgtggaccacatgggtgactatgaggatgtcctggcctccctggagaccttgaatcactctgtcctgaaggccatgggttataccaagaaggtatatgagggtgggagcaacgtggaccagtttgtgacccgcttcctcctgaaggagacggccaatcagatccagtcgctgctgagctcagtggagagtgcggtggaggccatcgaggaacagaccagccagctccgacagaaccacatcaaacccagccacagcgcggcacagacctggtgtggaagccccactcccgcctctgcccccaaccacaagctcatggctatggaacaaggcaagacccttccatctgccacggaggatgcaaaggaagagggtctggaagcccagatcagccgcttggcagagctgattgggaggctggagagcaaagcactgtggttcgacctgcagcagcgcctgtcagatgaagatggcaccaacatgcacctgcagctggtccggcaggagatggccgtgtgccccgagcaactgagcgagtttctggactctctgcgccagtatctgcgggggaccactggcgtgaggaactgcttccacatcactgccgtgaggctctcagatggcttcacctttgtcatctatgagttctgggagacagaggaggcgtggaagaggcacctgcagagccccctgtgtaaggcgttccggcacgtcaaggtggacacactgagccagcctgaggccctctccaggatcttggtgccagctgcttggtgcacggtgggacgggactgacagcctcccagaggcccgtggaggagcccaccagccccttcttcttgtgaaggaaatcccgtttttttctagacagacactttggtgcagaagcttcttttcaatccatcctccacaagaaggtgtttccctgttgttaagtgaaggaggccgcccctgcccccacctgagaaggcagagcagtgtctgtgctgccaggtcctggtgaagcccaaggttgaagggggcggcttcctggagccagcacccctgcctcctggtcctggcctctcccctacccctcacatggccacgcatgacccacactgaccacaccctgccctcttcggtgacattcttctacctagtaggagtcatgcccctgtagtgcccaacctagccaggtagccaccactgtgcccaggcgccaaataaaccctggttgggaaga

SEQ ID NO: 735 - DNA, 4229 bp, Homo sapiens
cactcgggtcgcgggcgttggcagccgggcgggtgggaggggccggagcaaaagttccgggcgcccgagccggctgctcgtgccatggagcggagtcccgacgtgtcccccgggccttcccgctccttcaaggaggagttgctctgcgccgtctgctacgaccccttccgcgacgcagtcactctgcgctgcggccacaacttctgccgcgggtgcgtgagccgctgctgggaggtgcaggtgtcgcccacctgcccagtgtgcaaagaccgcgcgtcacccgccgacctgcgcaccaaccacaccctcaacaacctggtggagaagctgctgcgcgaggaggccgagggcgcgcgctggaccagctaccgcttctcgcgtgtctgccgcctgcaccgcggacagctcagcctcttctgcctcgaggacaaggagctgctgtgctgctcctgccaggccgacccccgacaccaggggcaccgcgtgcagccggtgaaggacactgcccacgactttcgggccaagtgcaggaacatggagcatgcactgcgggagaaggccaaggccttctgggccatgcggcgctcctatgaggccatcgccaagcacaatcaggtggaggctgcatggctggaaggccggatccggcaggagtttgataagcttcgcgagttcttgagagtggaggagcaggccattctggatgccatggccgaggagacaaggcagaagcaacttctggccgacgagaagatgaagcagctcacagaggagacggaggtgctggcacatgagatcgagcggctgcagatggagatgaaggaggacgacgtttcttttctcatgaaacacaagagccgaaaacgccgactcttctgcaccatggagccagagccagtccagcccggcatgcttatcgatgtctgcaagtacctgggctccctgcagtaccgcgtctggaagaagatgcttgcatctgtggaatctgtacccttcagctttgaccccaacaccgcagctggctggctctccgtgtctgacgacctcaccagcgtcaccaaccatggctaccgcgtgcaggtggagaacccggaacgcttctcctcggcgccctgcctgctgggctcccgtgtcttctcacagggctcgcacgcctgggaggtggcccttggggggctgcagagctggagggtgggcgtggtacgtgtgcgccaggactcgggcgctgagggccactcacacagctgctaccacgacacacgctcgggcttctggtatgtctgccgcacgcagggcgtggagggggaccactgcgtgacctcggacccagccacgtcgcccctggtcctggccatcccacgccgcctgcgtgtggagctggagtgtgaggagggcgagctgtctttctatgacgcggagcgccactgccacctgtacaccttccacgcccgctttggggaggttcgcccctacttctacctggggggtgcacggggcgccgggcctccagagcctttgcgcatctgccccttgcacatcagtgtcaaggaagaactggatggctgagctggcccggggctgccccggtcttgtgccacagcactgttttctttctgccctcttcctaatgcccacactgcttgggcactattgcgcccctgcctccttgccaggctcttcctcctgtcctgcctggtccttttccatgactccaggctgtgcctctctccatgtttggtcccttctgtgcccatggtcaggagctattcgggtggcacctcgctggccaggctctcccgagtcgtggcacctccacaatgtgaattttctgaatccctattccaggatttctgggaataatgtttacttctagaatgggcctgttgtaaaccatctcatcgaggtgtggtaaagccattggatgaggaggggactgccatggaaaggagagtttgttacttacggttctgagaggaggggccacataggaaagccccacggtgggtcagaaggcggaaggagggaggggaacgtgtgggcaagagacttcctctggtttcctcaggaggaaatgggcaaggcagagtaagcaggggagacaggtttaagggtagctggcttgagtaatttcagtggctctcaggataggggctgccctttttgtctgatacctggccccgggatagtcaggacaggtgaatgttggcctggggtgtgacagccctgggagagccatgtgaaggaggcagctggcgccatcgctccggattagttggtttccataggaaaggcatgctttcagccagatgcttgccatctctagggattgggggattggctagcctgggaggatcagtctgtccaggtcagcgaggccccagataccagagcatcaagagtacaggaaatacagttaatgcagggcctctgtgtggctggatcctccgtctccatcagatcagctctgattgatctattcttgcacgatttcctctgaacacagggttccagagtacttaaacacaacattttttaaatcgtgatttcggcctatttccttgccaggcctgtttccccaccaggaaatgagataggaggactggatgaggatgtcctgttatagttgctgtggaggaagttcctctggttaattctcatcagcgtctgcagaaaagaaggaaagagggcacccttttcagttgggaagaaaggagaggggtggcgccatggacgtggccctaaacgctgtgggagagggaagaggaggctgggcctcgctgccctcttgtctctgctgacttcagcctggtcatgcttgctctgccacttgcgatttcatccctaatttcttcctccaccatgcctgcagacttttccctgggcttgttttttctcgcacatctctgaagagtttttaatcttcagctcatcatgtcccaggaagtggcatcataaaaggaaatatttttttttcctaggagcagtgttaaaatctgggtcacattcctgaccaaggacagcatcctgccttctgcccatccccttcagttcacaaaagctgacattttaaacaaatcatgactcacacgtattaattggttataaatatgttgtgtacactggttagataaaacttaaggccacaaggagggcccaggtaggcgatgtcagtgtgtgaaggggctggattgggcgtggtgaggatgttggcaaaccagtgcatgcacctggttggaagatgctcagcctcacaaaagctccaagccctttgggagccaaagtgtctgagagtgtgaccctctcctgtaaagtatttatcccacccattaatataatttctgtataataaacttgacctgaaattatttcattctttatattaaacttttaaaaatgttttttattttcaccttagatatgggaagagttttttttttttttttttttttaacaggataacttgagcaggctaggcctcttaaaaaaaaatttgagctaaaactcatttttcttttggcattttcttttcaatgttcttataagcaaagttcatccatgttgtagcatgtgttcaactttattttttcatcgggtaatattccattgtatggaatggtagtactacattttatttatcatgcatcgattggtggacatttggatcgtttctacttcttgactattatacataatgctgctaggaacttttgtgtatgagtttttgtgtggacatatgttttcatttctctttggtatatgcctgggagcagatttgctggatcatatgaaactctatttaacccttgagggactcccaaactgttttccaatgtggtgacacaattttatatcccatcaacagggcatgagggttctgatgactccacatccctcagtgctttttattatctatcttttaacttagccatcctagtaggggtaatgtggcatctcattgtgattttggtttgcatttccctgatggcgaatgatattgagcatcttttcatgagcttattggccatttgcatatcttcttaggacagctatctttagatcacttgctcattttttaattgggttatttgtctttttattattgagttgtaagagtccttttatagcctggcacaagtccctttaactggtatatgattataaaatttttctccgtgagctgtttcatttccttgatgatgtcctttgaaatactaaagcttttaattttg

SEQ ID NO: 736 - DNA, 2570 bp, Homo sapiens
cgcgcaatctgcttccggcctgcgagctcggtgttccgctttttgtgggccgggtgggtttcctaatctggtttcgtctgcctggttcatctgtgtgcgatggctccggactcggatcccttccctgaagggccgctcttaaagctgctacccttagacgctagagaccggggcacccagcgctgccgcctgggcccggccgccctccacgccctgggcgcgcgcttgggctcggcagtgaagatctcgctacccgacggcggctcctgcctctgcactgcctggcctcggcgggacggagcggacggctttgtgcagctggacccgctgtgcgcgagccccggggcggcggtcggggcgtcgagatcccggaggagtctcagcctgaatcgcctcctcctagtgccctgtccgcccctgcggcgcgtcgccgtgtggccggtgttgcgagagcgggcaggcgcgcccggtgcccggaatacagccgcggtgctggaggcggcacaggagctgctgagaaaccgaccgatctccctgggccacgtggtggtcgctccgccaggcgctcctggcctggtggctgccttgcacatcgtcggcgggacgcccagtcccgatcccgctgggctggtcacccctcgtacccgcgtcagccttggcggggagcctccgtcggaagcccagccgcagcccgaggtgcccctgggaggtctttcggaggcggccgactcgctgcgggagctcctccgcctcccgctccgctacccgcgcgccctgaccgcgctgggcttagcggtgcctcgcggggtgctcctggcggggccccccggagtgggcaagacccagctggtgcgggccgtggcgcgcgaggcgggcgcggagctgctggcagtcagcgccccggcgctgcagggttcccggcctggggagaccgaggagaacgtgcggcgggtcttccagcgcgcccgggaactggccagccgcggacccagcctcctcttcctggacgagatggacgccttgtgtccccagcggggcagtcgagcacccgagagccgcgtagtggcccaggtgttgacgctgctggacggcgccagtggggaccgcgaggtcgtggttgtgggagccactaaccggccggacgctctagacccagcgctgcgtaggcccgggagatttgaccgagaggtggtcattgggactcccacacttaaacaaagaaaggaaattctgcaagtgattacctcgaagatgcccatctccagtcatgttgatttgggccttcttgcagaaatgacagttggctatgttggtgccgacctgacagcactctgtagggaggctgccatgcatgccctccttcatagtgagaagaaccaggacaatcctgtgattgatgaaatagacttccttgaagcttttaaaaatattcagccctcatcgtttcgaagcgtcattggattaatggatatcaagcctgttgactgggaggagattggtggccttgaagatgtaaaactgaagttaaaacagagcattgagtggcctctgaaattcccttgggaatttgttagaatgggcctgacacaaccaaagggagttctcctctatgggccccctggatgtgctaaaaccactctggtgagggccctggccacaagctgtcactgctctttcgtttcagtgagtggagctgatctgttttcaccgtttgttggagattcagaaaaagtgttgtctcagatatttcgacaagcaagagcaagcactccagcaattttgtttttggatgaaattgattcaatcttgggagctcgctcagccagcaagacaggatgtgatgttcaagaacgagttctttctgttctcctgaatgaattagatggtgttggacttaagacaatagagagaagaggaagtaaatcaagtcaacaggagtttcaagaagtttttaaccgaagtgtcatgattattgcagcaacaaatagacctgatgtgttagatactgctttgttacgacctggaagattagataagatcatctatatcccacctccagatcacaagggcaggctttctattttaaaagtctgtacaaaaaccatgccaatagggcctgatgtctccttagaaaacctcgcagcagaaacctgttttttttctggagctgatcttagaaacctctgcacagaagctgctttgctggctctgcaagaaaatggactagacgcaactacagtgaaacaagagcactttctaaaatcacttaagactgtaaaaccgtcgttaagttgcaaggacttggctttatatgaaaacttatttaagaaagaaggattttctaacgtggaaggtatttaaaaatcaccttaaactcttgttcagttcacattaattgaaatgtgaacttgcctgtcgtttgcaacttcacacttttagaatttgtgtttatatttcctgtaagtgaataaataaaacaaaacaaaacaaaaaaaacttgtgcctgataagctaaggctcatttatttttaaaaggcatattaaataaaatactgtaatttaggaagaaa

SEQ ID NO: 737 - DNA, 3421 bp, Homo sapiens
agttagttccctaacccgagtgaagccacttccgggcttcccgggcgccttccgcagtcctcttccgggtgatggcggccgggtgccccggatgtagccctggcgcaagcatctcttcttttttccacctcgccttccgcggattcccagcttgagaaacacctctttgccccgtcatgccaaagaggaaagtgaccttccaaggcgtgggagatgaggaggatgaggatgaaatcattgtccccaagaagaagctggtggaccctgtggctgggtcagggggtcctgggagccgctttaaaggcaaacactctttggatagcgatgaggaggaggatgatgatgatggggggtccagcaaatatgacatcttggcctcagaggatgtagaaggtcaggaggcagccacactccccagcgaggggggtgttcggatcacaccctttaacctgcaggaggagatggaggaaggccactttgatgccgatggcaactacttcctgaaccgggatgctcagatccgagacagctggctggacaacattgactgggtgaagatccgggagcggccacctggccagcgccaggcctcagactcggaggaggaggacagcttgggccagacctcaatgagtgcccaagccctcttggagggacttttggagctcctattgcctagagagacagtggctggggcactgaggcgtctgggggcccgaggaggaggcaaagggagaaaggggcctgggcaacccagttcccctcagcgcctggaccggctctccgggttggccgaccagatggtggcccggggcaaccttggtgtgtaccaggaaacaagggaacggttggctatgcgtctgaagggtttggggtgtcagaccctaggaccccacaatcccacacccccaccctccctggacatgttcgctgaggagttggcggaggaggaactggagaccccaacccctacccagagaggagaagcagagtcgcggggagatggtctggtggatgtgatgtgggaatataagtgggagaacacgggggatgccgagctgtatgggcccttcaccagcgcccagatgcagacctgggtgagtgaaggctacttcccggacggtgtttattgccggaagctggacccccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgtactggggccttggctgtgctgatggccagaagccaggggccttctccacagtccctttggacttgtcttggtccctgagtactcccatgaagatccttcttggaggtgcctgtcaggtatcctgtggcctccctgcctggactctgcttgccgtgtaaacacccccaactgcgctgctctgtgctcctctcccaggtttcttgttcgattcctcttaggtctttggctttcaggacctcagattctttatccttgtagccaccagaggacagagccccagaagtggatgttttaggcccagaaggaccagggcatcgagaagacattgggaccctgttgggggtgagcatggaaccctcttactctcgcttcaccctctcaagctccttagatgctgggcagaagtgggatgagtggcccaagaccgagatccctaaggttctgagagccagtgtcttccctaatctggctttcctctatccttgccgtcgttcccacagcccttcagtgaagtgcaaactcagtggccaagtgtgggccaagtgtgcattgtactggcacagagaggggcagtgactcactggagatcacaggaatcaaagggctggcccagacccagtgggctcctttcccagacctttcttggcacaaagcctttgctgcctggccttggaggccctgcggcctacattctctggaccccactatgtgcctggcacagggctagtgccttgaggaaactgaggtagctgggttggtccccttccaggaattcagagtctggtggcaggggcatgggaaatagacagatgtaattctatagcctgggcctggcaccctccacctccacgccccaccagcattgccttacgcctcccttgccccacgttagatggtttcttccggttttgcactctggctgccccttggagtctcctggggagctgtaatatctctttggagattcagattgagctggtctaggttgtggcccaggcattgggcattttggaagcccccaggtgttttcagcttgcagccaggccgagagagagcccctgagtcagatccccatggtttaggcacacctagcgggaggggtggctcctggaccccaccgtggttggagagctgagcatgtgtgtggctttagtggggtctgttagttatgggggtctgggcactggagctgcaggacacttgggatcccaggtcagaaagggccagatgagcaactaggaaagacttgggggccagggcggagtggggtcacctgacactcttgtgaggccccttctagtgcctgctcacaccggaatttcattcactccaagaagccatcaggggtaagataccttcctttaaacgtcactaagaaagaagaggcctgccggtgacacagtaagatgccattgatctaaagatgcgtcttgatttcagaaaggtccggaagtggaaagcaggtttcagggctgctgaggtacagggttctcctgtaggccccagggatggtctcaggggtgctgagtgcgtgcgtggtaaatggatggagcccaggggcgcctcctgccagtgtcctccaggcactcaaacctagcccttctgaagccgacctcacgtgacctcacagcccctcctgaaggcgcctcactgatgacggtgggtggaataacagcccccagagatgtccaggtttggaaccccaggacgtgggaaagtgttaccttgcgtggcaaaagggacccggcgcctgtgcttcagttcaggatttcgtggtggggagatgaccgtggatggttgaggtgggccctgagtaatcatgggggcccttataagggaaggggagtcacgagggtctgcgcatgaagcaaggaagcttctggctgtgaagatggcaagaaggcctggggccaggcgatgaggtggcccctggaggagctggaaaaggcattggattctgccccagagcctccgtggagaaacaaagccgcactgacaagacttcagcctggtgaaaaccattttggactcctgacctctagaactgtaagataataaattggtgtggttttcaacctctca

SEQ ID NO: 738 - DNA, 4562 bp, Homo sapiens
gcttcctccagagggcgggaaccttggacgtggcggggctgggtcagtcagggcgctgggcccagcctctctgcaggctggccttccgcgctgccgtgaagcccccgacaggtcccacgcctgcctaggtagaccggcgccagcccgagtgacgcctggcgtgtggccgcgggcaggcggctccgtgcggcggggcgggcgggtgccacacctgtgcgggcaagggcggggcgggaaggtgcgcaggcgcgctcggggctggtgggcggtggctcctgggaagttgcgcagccgaactggccggctgggcgcgcgctcttgcggtggcgtaatctctcagcctttctgtgtctcctttcctccgcctcagtttggggcgggtcgggggaatggctgaggagatggagtcgtcgctcgaggcaagcttttcgtccagcggggcagtgtcaggggcctcagggtttttgcctcctgcccgctcccgcatcttcaagataatcgtgatcggcgactccaatgtgggcaagacatgcctgacctaccgcttctgcgctggccgcttccccgaccgcaccgaggccacgataggggtggatttccgagaacgagcggtggagattgatggggagcgcatcaagatccagctatgggacacagcaggacaagaacgattcagaaagagcatggttcagcactactacagaaatgtacatgctgttgtcttcgtgtatgatatgaccaacatggctagttttcatagcctaccatcttggatagaagaatgcaaacaacatttgctagccaatgatataccacggattcttgttggaaataaatgtgacttgagaagtgccatacaggtacccacagacttggcacaaaaatttgctgacacacacagtatgcctttgtttgaaacgtctgctaaaaaccccaatgataatgaccatgtggaagctatatttatgaccttggctcataagcttaagagccacaaaccattaatgcttagtcagccccctgataatggaattatcctgaagcctgaaccaaagcctgcaatgacgtgctggtgctaaataacagtctttattatattatctaattttgactaaagaaatacttttgaagtatgacagtattaagtcataagatttaatctcaactataatgggtcatcttgacactttgctgtttgtcattgtcacgcttttgtattttgtatctacttaagtttgtcactgtgacaacacaggaaaagttggttttcaggtgagattgaaaatgaagcaaagataggatgaatctgaacatctctccatctagagcccaatgaaggaagcttcaaatgagaacatgatggaatcagtaaccattcaatcttttgtcctaggattggaaaaaaatgttaaaggtttaggacacacctaatagtatgtcctttgaatgggaagtgttcttaataggataaaaactggtatttgcctctccccagagtactttttttgttttttcatagagacggggtcttgctatgttgtccaggctggccttgagctcctgggctcaagcaatcctcccacctcagcctccccagtactgggactgtaggtactcaccactgcatctggcctttctttgttttattaacatatttagttttgttattattggtatgttttagagccaagactttagttccagtgggataagaaggcatagaatgttttctggttcccagtccataaagaatgacttttccaagagttctagatgtttgattttctaattaatacttatcagatctacaaaaatcattattattttaaaagagttatttgagtttctttctttctttttttttttttttttttttgagatggagtctcgctctgtctccaggctggagtgcagtggcgtcatctcggctcactgcaacctccgcctcccaggttcaagtgattctcctgcctcagcctcccgagtagctgggattacaggcgtgcactaccacacccagctgatttttgtatttttagtatagatggggtttcaccatgttggccaggatggtctcgatctcttgacctcatgatccacccgcctcagcttcccaaagtgctgggattacaggtgtgagtcactgcacccagccgagttgctttcttactaaatcctattaaaatatgcaaaaataagtcagattttaaggcaaataaagtgacataaggtgctttatattttattttggtatatttaaacagtgaaaaactaactgaaagcacatgaagagttgtaacttgggggaaaataggtaaacatagcttctagctaacacaggagacctattcttagcctttactaatttcaagcagtgtatcccatatggtatctcttgctcttccttcaactccaataaatttaatgactaaatgccaagttaacaaatcaacttccatttggattgtaggtgtgaaggcacaactctaattgctattagtctacatgtatttctgtaatagtattgtgtcatatcaatttttaagatgtctaaattttatggtcacaagttatccctcctcagtatgaaaaataaattagatattgaaaaatgtctaaacttcagtgatggaaagaatatttcaagaagttttttaacctaaatacttttattttgaatttaagtctttgcacataaaatatagcaagcttacatattaaactatttacgtaaatggaatgtaagccatgactttaactgaagtgttcacattcactaattttgatagattgctgtccttaataattttggaggaaattaagccaaatgattattgtactacagtattttcagaatatgggaaatcaattaaaaatgtaatctaatctagtttaagatttttgtttaatcatcatggtggtcctacctggataatttaactataaagacaaagtaattctattaaatgaactaactgaaaataataattataggaagtgattattccattttaagtattagagctcaaattggctttatttgcatttagggagatcatgttttcttaatcatgctggaatttaaaaattgttttacttgtatcgaaattaaccttgatttataactatttttgtaataaaacaatgacagctgtagtaactatgatgggtgtaacaacatttttttaaagaagggaatctgtttatcgcttttcaaaatattttctaaagtgggggaagaaagtttatagactttccaagcacatttatggttttttattactattattatggttttaaaaagagtaactttatttctttttgtaaggaattaagtaatatcctttacagttctgtgaaaggacttattttttaactgtaatatttattagttttaaaatatttgtatctcatttgtaacaatttgttttaattttttatatatatgtttttatttttaaaaaacataccagttgaatggggttaaagctttcaatatcttaaaatatttataaaacatttcactgttgcaaaatcacttccaaaatgatagctatctaacaactaattactaatttttaaagaacaaatcacacatttaaaaaatctgtagaatttattttaactatgacctttaattgaaaataaataattaaaatatcagacatgttttggaaaagtcttaatttgagaacaccaaaggaaactaccccagaatctaatgtagttcgctattaataacaatgcattattgaaagtatattgcaaatacatgtttcctcatgaaatctaagtaattttgttgtggaatagtgtcactgttacatttcccccatgaagttcaataaaccagcttagccacaaagaaattgtgttttattttctttgtttggttactgggtagagtataaaataaaacaatctttttttcctcctggtttccagataatattatatatatgatacacttttgaaaacaacaaaaagcccccaacccattggacaattattttcttgtatacatttgaggtcaaagaacacttcaggaaaaaaactcaacaaagtattaaaattagctgataacacagcttttgtatttgtgtgttttagtaatccagcttgttttagaatagttcagtgcaaaaagcaaatggtgcaagaggagttgatgtgtatttagacgtaaaagcatttaacagaatgaataactatagaaagtatgagaaaagagaacgaactacgtctcaggtataagattgcagttactgatttagacaccataggattagggatgtgggggcctctgatgttgattctgcttcccctggtcagtttattttacgtataagttacccttgtgttcaaacacaaaattgacattattcatgaaggactgctttcttaatcagatattaagaagttcgtcatgtattttgggagcacgtttgctacagcctgtgtggcaagggcgaatgcacttggtttgttggaataacctgatttatcaaacatttatcaagtatgggtcatgtgttctctatttgtgttagtggagctacata

SEQ ID NO: 739 - DNA, 2601 bp, Homo sapiens
cctgcggcgggctttagggagtggtccctggctgtggatagatctgctgatgagtccaggccccggtccattctcctcgcgctgcaaggatgctcctgggatttcggagaggccgcaggagtcatttcaaacacatcatccatggccttttacctgcagccagcgttgctccgaaggcagctgtgccacgcacacctcctccccgcagccccaacccatctccagagagaccaagatctgctctggcagcagccattctggcgacaacattgactgggcggacggttgctattcctcagcctcgccagaggtcccggtctgagagtgatgtgagcagtgttgaacaggacagcttcatcgagccctatgccaccacctcacagctgaggcctcggccaaattggcagagtgagatgggaagaagatcttctttgccatcctttgaaacactggactatggggacgaagaggacattgaaactcagctgtcatccagcggcaaggaattgggggatgtcagtgcccgggaggacagaggaggccacagtgatgacctgtacgctgtgccacacagaaatcaggtgccattgttacatgaggtgaacagtgaagacgatgaaaatatttctcatcaagatgggtttccaggctcccctcctgcaccacagcggacacaacaaaaagatggtaaacaccctgttctgaatttaaaggatgaaaaacctccattatgtgagaaacctccaccctccccagatataactggtagagcacgtcaaagatatacagaaataaccagagaaaagtttgaggcattaaaagaagaaaatatggacctaaacaatatgaatcaaagccttacccttgaactaaacacaatgaaacaagcaatgaaagaactacagttaaaacttaagggaatggaaaaagagaagagaaagctcaaagaggctgagaaggcgtcgtcacaggaagttgctgcacctgaattactttatctgcgaaaacaagctcaagaactggtggatgaaaatgatggattgaaaatgactgtccatcgtttgaatgtagaactcagtcgatatcagacaaaattcaggcatttgtccaaggaagagagcttaaatattgaaggcctcccatccaagggccctataccaccctggttgttggatataaagtacctgtcaccattgttgctggcttatgaagatatgatgaaagagaaggacgagctcaatgccaccctcaaggaggaaatgagaatgtttaggatgcgagtccaagaagtggtgaaagaaaatgaagaattgcaccaagagttaaataagagtagtgctgttaccagtgaggaatggcgtcagcttcagactcaagcaaaactggttttagaggaaaacaagttgttgctggagcagttggagattcagcaaaggaaagccaaggacagccaccaggagcgcctccaagaagtttctaagctgactaaacaactaatgctcctggaggcaaaaacccacggccaggaaaaggagctggcggagaacagggaacagctggagattttacgtgccaaatgccaagaactcaaaacacactcggatggcaaaatcgcagtggaagttcataaatcaattgtgaatgaattaaaaagccaattacagaaggaagaagagaaagaaagggctgagatggaggagttgatggagaagctgacagtcctgcaagcgcagaagaagagcctgctgttagagaagaacagtttgacagagcaaaacaaagcactggaagccgaacttgaacgagcacagaaaatcaataggaaatctcaaaagaaaattgaggtcctcaaaaagcaggtggaaaaagccatggggaacgaaatgtctgctcatcagtacctggcaaaccttgttggcctggcagaaaacataacccaggaacgtgacagtcttatgtgtttggcaaaatgtttagaaagtgagaaggatggagtgcttaataaagtcataaaaagcaacattcgcctgggaaagttagaggaaaaagtcaagggctacaagaagcaggcagcactgaagctgggggacatcagtcaccgtctgctggagcagcaggaggacttcgccggcaagacagcccagtaccggcaggagatgcggcacctgcaccaggtgctgaaggacaagcaggaggtgctggaccaggcgctgcagcagaacagagaaatggaaggtgaacttgaagttatttgggaatctaccttcagggaaaaccgaagaatccgagaacttctccaggacacactcacgaggacaggcgtgcaggacaaccccagagctctggttgcccccagcctcaatggcgtctctcaggcagacctgctggacggctgcgatgtctgctcctatgacctgaagtctcatgcccccacctgctagaatctgcgggagcccgtggtgtagcctcctctggcctgaaaggtctgcctcacacaggccttccctgcagggcagcccatggtggcagccggaggtgcgtaagcccactgaacgctgcagggcagggaagaaataaatggtctcatagtttaatccattg

SEQ ID NO: 740 - DNA, 1232 bp, Homo sapiens
aggacacggctccagtggcggcgcggcccagggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtgccgttaattaaggaaaagttgagccagggcgtgaccctcgtcgtggacagatacgcattttctggtgtggccttcaccggtgccaaggagaatttttccctagattggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcagagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaattgtt

SEQ ID NO: 741 - DNA, 804 bp, Homo sapiens
gctggggcttgcgtgggaggaaggtgactgtgaggaaggtgtgtgtccaccgagcacttggattcagcttcttcatttccaacatggaagaaacttacaccgactccctggaccctgagaagctattgcaatgcccctatgacaaaaaccatcaaatcagggcttgcaggtttccttatcatcttatcaagtgcagaaagaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaatggaaatgcacagtaactgaatacctatctcatcaaatgccagaccctagaagactgttgcttcttcttctaccagtgggttctcattttcctcctaatctaattatagaatggtaaactccctgtgactttccaaactgacaagcacacttttttcctccccccttgaatcctcatttaatgcaagaaccctcatactcagaagcttccaaataaacctttgatacagattg

SEQ ID NO: 742 - DNA, 3017 bp, Homo sapiens
ccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatcgtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtcagctcgtttgcttcgtctccgtgtgtccacctggcctcttccccctgccctggccaccctccagtgtcaaaggaaacttcctcgtgacacgtgctaaagcatggtgaggaggactttgattgggaccattgagatgggtgtgggaccctttccttggggcctggggggagatggggctccaccccgacgtagcagggcaggggttggaggagcgaggagcagtatagggtccatgggtgggaatgactgtgaggagacatcagggctgagggggctctggctaaacccacctcacagagtccttgctgcaggcaggcagggcgatcagacattggctgcaaacggtcagagaggaacccagtcaggtaccattgagggtggtcagatattatggttaaccaaattagggttcttgctaaaactggatttcataagaaagggcaaagagggccctaggagaagattccagagcctggccagagtttggccaagtagagaatctttgtcagcacgccaacaacatcccgaccctgagacctccagtttgtctttctcactgtctccgcctgctgcagtctgctgtcatccctgagcatccctgcccctgccctgcacacctgtgatgcttgcccggacaggtcctgatggcagagtctcccacaacatcagtgtctccacatcaccaggtccgacagtggcttcaccatcctcacctaacctagctgaccagcaacatcccaccctgtcaatcacaacctctttctatttaagaaaattatatatttatggggcacagtg

SEQ ID NO: 743 - DNA, 2233 bp, Homo sapiens
gccgggccggagcggggtgggtaggggacgcgaggcggagcggggccccacacaggccgcggcggctggctcgggcccctacggtcccggcggcggctggaggaggaagccaggcggctggcggaggaggagagacggaggaggccgagaccggagcgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacagagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcccctcagcttctctctggttttctca

SEQ ID NO: 744 - DNA, 4453 bp, Homo sapiens
gtaaggggtgggctatagggccagatcgccgcgcgagggtggtgggcatcgaggtcccagcagcggacgagggaggtgccgccgtcgcccaggatgggctgggaatgaagcgatgtagccttttaagagatttgctctgacccatctgaagtccatatggctctgtatgatgaagacctcctgaaaaatcctttctatctggctctgcaaaagtgccgccctgacttgtgcagcaaagtggcccaaatccatggcattgtcttagtaccctgcaaaggaagcctgtcgagcagcatccagtctacttgtcagtttgagtcctacattttgatacctgtggaagagcattttcagaccttaaatggaaaggatgtctttattcaagggaacaggattaaattaggagctggttttgcctgtcttctctcagtgcccattctctttgaagaaactttctacaatgaaaaagaagagagtttcagcatcctgtgtatagcccatcctttggaaaagagagagagttcagaagagcctttggcaccctcagatcccttttccctgaaaaccattgaagatgtgagagagttcttgggaagacactccgagcgatttgacaggaacatcgcctctttccatcgaacattccgagaatgcgagagaaagagcctccgtcaccacatagactcagcgaatgctctctacaccaaatgcctccagcagcttctgagggactctcacctgaaaatgctcgccaagcaggaggcccagatgaacctgatgaagcaggcagtggagatatacgtccatcatgaaatttacaacctgatctttaaatacgtggggaccatggaggcaagtgaggatgcggcctttaacaaaatcacaagaagccttcaagatcttcagcagaaagatattggtgtgaaaccggagttcagctttaacatacctcgtgccaaaagagagctggctcagctgaacaaatgcacctccccacagcagaagcttgtctgcttgcgaaaagtggtgcagctcattacacagtctccaagccagagagtgaacctggagaccatgtgtgctgatgatctgctatcagtcctgttatacttgcttgtgaaaacggagatccctaattggatggcaaatttgagttacatcaaaaacttcaggtttagcagcttggcaaaggatgaactgggatactgcctgacctcattcgaagctgccattgaatatattcggcaaggaagcctctctgctaaaccccctgagtctgagggatttggagacaggctgttccttaagcagagaatgagcttactctctcagatgacttcgtctcccaccgactgcctgtttaagcacattgcatcaggtaaccagaaagaagtggagagacttctgagccaagaggaccatgataaagataccgtccaaaagatgtgtcaccctctctgcttctgcgatgactgtgagaaactcgtctctgggaggttgaatgatccctcagttgtcactccattctccagagacgacagggggcacacccctctccatgtggctgctgtctgtgggcaggcatccctcatcgacctcctggtttccaagggcgccatggtaaatgccacagactaccatggagccactccgctccacctggcctgtcagaagggctaccagagcgtgacgctgctgctgctgcactacaaggccagcgcggaagtgcaggacaacaatgggaatacgccactccacctggcctgcacctacggccacgaggactgtgtgaaggctctggtttactacgacgtggagtcgtgcagacttgacattggcaatgagaaaggagacacccctctacacattgctgcccgctggggctaccaaggcgtcatagagacattgctgcagaacggagcgtccaccgagatccagaacagactgaaggagacgcccctcaagtgtgcattaaactcaaagattctgtctgtaatggaagcctatcacctgtccttcgagaggaggcagaagtcgtccgaggcccctgtgcagtccccgcagcgctccgtggactccatcagccaagagtcctccacttccagcttctcctccatgtcagccagctcaaggcaggaggagaccaagaaggactacagagaggtagaaaaacttttgagagcagttgctgatggagatctagaaatggtgcgttacctgttggaatggacagaggaggacctggaggatgcggaggacactgtcagtgcagcggaccccgaattctgtcacccgttgtgccagtgccccaagtgtgccccagctcagaagaggctggcgaaggttcctgccagtgggcttggtgtgaacgtgaccagccaggacggctcctccccgctgcatgtcgccgccctgcacggccgggcggacctcatccccctcctgctgaagcacggggccaacgcaggtgccaggaacgcagaccaagccgtcccgctccacctggcctgccagcagggccactttcaggtggtgaagtgtctgttagattcgaatgcaaaacccaataagaaggacctcagtggaaacacgcccctcatttacgcctgctccggtggccatcacgagcttgtggcactgctgctacagcacggggcctccattaacgcttctaacaataagggcaacacagcgctgcacgaggctgtgattgaaaagcacgtcttcgtggtagagctgcttctgctccacggagcgtcagttcaggtgctgaacaagcggcagcgcacggctgtagactgtgctgaacagaattcaaaaataatggaattgcttcaggtggtaccaagctgtgttgcttcattagatgatgtggctgaaactgaccgcaaggagtatgtcactgttaagatcaggaaaaaatggaactcaaaactgtatgatctaccagatgagccttttacaagacagttttactttgtccactcagctggtcagtttaagggaaagacttcaagggagattatggcaagagatagaagtgtccctaatttaaccgaaggttctttgcatgagccagggaggcaaagtgtcacactgagacagaataacctgccagctcagagtggatctcatgctgctgagaaaggcaacagcgactggccagagaggcctggactgacacagactggccctggacacagacggatgctgcggagacacacggtagaggatgcggtcgtgtcccagggcccggaggctgctggccccctctccactccccaagaggttagtgcttcccggtcctaacaggaatgaggagttgttgaacccactgctaggaagcaaggatgcaacaagatgatgctgagcgtgaacacatctgagaactaaatgtgcttccatgagactggcttgagaagtcttcagcaccaagttcctgaaagcttttctgtggcaggaaagaatgcaacaaaaaagttaaccaccaccatctctctcctcttcaaagctaatgaatacaattgaaacagacaaaaattccagtagcatccagatccttaagccagaggtgcatgcttctttttaagtatgagggtttgttggtcacagtgggagaggtttcaccaccgcattctgacctcctcctcccaaaaggtgctaaacctctctgacctgtgtacattcacaaaccacagctagaattcctccacctaggattaagctggagagaagtaagtaatttaggtttcatggtactgtagaggccaggctgaaatgtcatatctgaaggaagaaagcagcagctggacaatgtttctttgcaaagcaacactcgaaccaaaagatgcctcaatcccattttgatattcattttagtgaaaggatgcatcagacctgttccacatcatgcacatgggaaagggtggttatcattttccttctaacaagtaggtacagatattcggttactacacgtgcacctgtagcagtatttctagaaacatccctttttgttgagaacctcccttgaatgtctgtcacactcacacctgacgggatggttactggattagagagtagatttggcacatcttttcttagtcttttgattcaaattcaaaacttaacagcacaaaccaggtcagagttactttcggttagaatttattgccatttattcctttttataaatttctatagattatactgttatttttatgttattggcctagagctacacgtatatgggtttgtcctgagtccgttttcaaatgaccttgtgatagggaaatggttttgtccatgttcttggaaatacttgtgtatgtacagaaggaagggagggattatttttctacaaagtaatttatgatttctaattttctaatgtgccttggatatgtgccaaatgatggaaaagaaacagtaaactttatgattcttgactgtg

SEQ ID NO: 745 - DNA, 1873 bp, Homo sapiens
gaatgcgtagtcccagcctcagcacaggggagccaccttgaagctctcaaatatcactgttgtgaatacagagagggaaaaccaactgtaacgtgccacccaaatgtaagttttactcatattttgatgttaggatggatagcttggaaaaagttggagggtacggcctttactatgaggcatctatgaaggatcaggaatggatgtagacaaggaactaggaatggaaagtgttaaagctggagcctctggaaaaccagaaatgaggctgggcactcaggaagaaacaagtgaaggtgatgctaatgaaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatccccaaggccccagaagaaaccatccaatccaagaaggaggacctccccaagtcctcagaaaaagccatccagcccaaagagagtaacatccccaagtcctcagcaaaacccatccagcccaagctgggcaatattcccaaggcctcagtgaagcccagccagcccaaggagggtgacatccccaaggccccagaagaaaccatccaatccaagaaggaggacctccccaagtcctcagaagaagccatccagcccaaagagggtgacatccccaagtcctcagcaaaacccatccagcccaagctgggcaatattgccaagacctcagtgaagcccagccagcccaaggagagtgatatccccaagtccccagaagaaaccatccagcccaaggagggtgacatccccaagtcctcagcaaagcccatccagcccaagctgggcaatattcccaaggcctcagtgaagcccagccagcccaaggagggtgacatctccaagtccccagaagaagccatccagcccaaggagggtgacctccccaagtccctagaggaagccatccagcccaaggagggtgacatccccaagtccccagaagaagccatccagcccaaggagggtgacatccccaagtccctagaggaagccatccagcctaaggagggtgacatccccaagtccccagaagaaaccatccagcccaagaagggtgacatccccaagtccccagaagaagccatccagcccaaggagggtgacattcccaagtctccaaaacaagccatccagcccaaggagggtgacattcccaagtccctagaggaagccatcccacccaaggagattgacatccccaagtccccagaagaaaccatccagcccaaggaggatgacagccccaagtccctagaagaagccaccccatccaaggagggtgacatcctaaagcctgaagaagaaacaatggagttcccggagggggacaaggtgaaagtgatcctgagcaaggaggactttgaggcatcactgaaggaggccggggagaggctggtggctgtggacttctcggccacgtggtgtgggccctgcaggaccatcagaccattcttccatgccctgtctgtgaagcatgaggatgtggtgttcctggaggtggacgctgacaactgtgaggaggtggtgagagagtgcgccatcatgtgtgtcccaacctttcagttttataaaaaagaagaaaaggtggatgaactttgcggcgcccttaaggaaaaacttgaagcagtcattgcagaattaaagtaaacatgtattctg

SEQ ID NO: 746 - DNA, 3613 bp, Homo sapiens
cctggctgggacggaagttgcaccacaagtacaattagtttcagttttgtttcttttccaggcacccagcaacggcggcctccaggcctcaggccccctcaccatcctagaggtcaagatcagctctggctagttctcacaggtctgacccaacaagtagcactgacatttttacgtttgctggatgtacacacggaagtggaggaggaggaggagaaggaggagggcagctccttagctcaagagcaagtggcccaaggcctcagaagactagaaggaagttcctggccattcagcatggtttcccacgggtcctcgccctccctcctggaggccctgagcagcgacttcctggcctgtaaaatctgcctggagcagctgcgggcacccaagacactgccctgcctgcatacctactgccaagactgcctggcacagctggcggatggcggccgcgtccgctgccccgagtgccgcgagacagtgcctgtgccgcccgagggtgtggcctccttcaagaccaacttcttcgtcaatgggctgctggacctggtgaaggcccgggcctgtggagacctgcgtgccgggaagccagcctgtgccctgtgtcccctggtgggtggcaccagcaccggggggccggccacggcccggtgcctggactgtgccgatgacttgtgccaggcctgtgccgacgggcaccgctgcacccgccagacccacacccaccgcgtggtggacctggtgggctacagggccgggtggtatgatgaggaggcccgggagcgccaagcggcccagtgtccccagcaccccggggaggcactgcgcttcctgtgccagccctgctcacagttgctgtgcagagagtgccgcctagacccccacctggaccacccctgcctgcctctggctgaagctgtgcgtgcccggaggccgggcctggagggactgctggccggtgtggacaataacctggtggagctggaggcagcgcggagggtggagaaggaggcgctagcccggctgcgggagcaggcggcccgggtggggactcaggtggaggaggcggctgagggcgtcctccgggccctgctggcccagaagcaggaggtgctggggcagctacgagcccacgtggaggctgccgaagaagctgctcgggagaggctggcggagcttgagggccgggagcaggtggccagggccgcagccgccttcgcccgccgggtactcagcctggggcgagaggccgagatcctctccctggaaggggcgatcgcacagcggctcaggcagctgcagggctgcccctgggcaccaggcccggccccctgcctgctcccacagctggagctccatcctgggctcctggacaagaactgccaccttcttcggctgtcctttgaggagcagcagccccagaaggatggtgggaaagacggagctggtacccagggaggtgaggagagccagagccggagggaggatgagccgaagactgagagacagggtggagtccagccccaggctggagatggagcccagaccccaaaagaggaaaaagcccagacaacccgagaagagggagcccagaccttggaggaggacagggcccagacaccccacgaggatggaggaccccagccccacaggggtggcagacccaacaagaagaaaaagttcaaaggcaggctcaagtcaatttcccgggagcccagcccagccctggggccgaatctggacggctctggcctcctccccagacccatcttttactgcagtttccccacgcggatgcctggagacaagcggtccccccggatcaccgggctctgtcccttcggtccccgggagatcctggtggcggatgagcagaaccgggcactgaaacgcttctccctcaacggcgactacaagggcaccgtgccggtccctgagggctgctccccttgcagcgtggccgccctgcagagcgcggtggccttctccgctagcgcacggctctatctcatcaaccccaacggcgaagtgcagtggcgcagggccctgagcctctcccaggccagccacgcggtggcggcactgcctagcggggaccgcgtggctgtcagcgtggcgggccacgtggaggtgtacaatatggaaggcagcctggccacccggttcattcctggaggcaaggccagccggggcctgcgggcgctggtgtttctgaccaccagcccccaggggcatttcgtggggtcggactggcagcagaatagtgtggtaatctgtgatgggctgggccaggtggttggggagtacaaggggccaggcctgcatggctgccagccgggctccgtgtctgtggataagaagggctacatctttctgacccttcgagaagtcaacaaggtggtgatcctggacccgaaggggtccctccttggagacttcctgacagcctaccacggcctggaaaagccccgggttaccaccatggtggatggcaggtacctggtcgtgtccctcagtaacgggaccatccacatctttcgggtccgttctccggacagttaaaggggctaggactagggtgagagggagtggggagggagagggcaggaaggaggcagagctgtccgtgggaggtggaggccgaggacattttcctgaagggcaggggttggcaacttttcaacatggagtgccaaactgctaacccgtcttctagtgtgtgagaatagggaccaaggtggtggcgtgaccttaactctcagaagcagaggaggcaggtgggtggagggggatgctgggagttcacctgcctcttgctttttgtgggtggctgctgccaccaccgccgctgctatatagtttaggtttctgaggtttgtgagcctgtcctgctttgcattcttcaaaaccattcctgatagagtagccgagggagagtcttggggccaagaagggcccagggtgggtcaggcgtgtgcactgtggaacagagctgagaccccggccccccttggactggcacagggtcctacagagtcagaggaggcctgagatttcgaatgggcagtgaatggcctcttctgccagccacaggcaggatgctccttgatcacggcatcccccggcggtagtacagggtgagcttgcaggagggtctgcaagtgcagacagcagctggggccaaagaggtgttaggttcaaaggctgcgaagagaataggctactggaaaaccaaacccaacagaattcacgtccaaaaatccacattctccatcgcttctcagccttttggctaagattaagtattaaaaaaaaaccaggctctgccaggcgcagtggctcatgcctataatcccggcactttgggagtctgtggcaggaggattgcttgaggccaggagtttgagaccagcctgggcaacatagcgagaccccatctctacaaaagattaaaaattagctgcgtgtagtagcatatgcctttcaacgtagctactcaggaggctgaggtgggaggatcccttgagccgaggagtttgagtctgcagtgagctatgatcgcaccactgcattccagaccccatctcgaaaaaaaaaaaaaaaaaaaaaa

SEQ ID NO: 747 - DNA, 1953 bp, Homo sapiens
ccggcgtttccgtaggagccgggcgggagtcgccggggctccttcctgtggtgcagcttcgggtctcggagtttggcccctactctgaccccaccccagctccgctccgccttgggttccggcagaacccgccttgcggtagccatggcagcaggctccgaggcgaccactcctgtgatcgttgcggctggggctggaggggaggaaggtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggttctctttgttcccagacactggtggcattacgtagaatccattgatcctgtcactgtcagtataaactcatggattgaactggaagaggatcacctagcccgggtagaagaggcaatcacccgtatgcttgtgtgtgccctgaaaactgcagagaatccacaaaataccagagcctggttaaaccccactgaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaaggaagaagtttatgattcaagtggaagatgacttttaaaataatattttttaaatatatatttttaagtagtatgactaaaataaagatgaaccagcaaaaggtcagtttgcacatttgtaaatgtatttatccttaccgaattacatgtcagtctgttgccaccttctttcatgcacattcctctttggccaaactggctgctctttgtttgtaagcttttgttcctctctcatcccatacttttagcctgtgtcaaatgtaagtcccaagtatttccagcaggaagtaatgtcttcctcagcctcaaccagggaccaaccggctgcttacttttgcaaataaaattttactagaa

SEQ ID NO: 748 - DNA, 1409 bp, Homo sapiens
ccaaaccactatgcccacgcacgcacccacccaaacagagcgttttctggtccccgagctcctcccgaccccacccgctcctacggcctccaaccggccccccccaggtctcgaccctctcccccaggcctcgaccctccccccccagccgctctagccccgcccggccgctctagcctccgctcctctcgctggtggaggttcccgaccgcgctcgctcccgcaactgggggcacggcagaggaggcagggccgacggcggtgggcggtgcgttgcgcaggctcgggcctcccgctcgccgctgcgttgggaccgcgcagcccggtgtgtgcagtggcctcagggatccggaaagtctaggactgaacttctcctaacatccagtaatggggacctggaacctgggcttactagagtgccgcgcgtagggctccaggtcgctggcttctgcgcttccttcctctccaaagttgagtatctcctatctgtgtcctcgtacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacacgaagactgccttgctggagcctgggtggccaccgtcatcggccttccccttctggccttcgatttccactgggtgaatggggaccgctcctctgccaacctgctcctgggaggaggcatggtgctggcagtggctggcggccacctcggccctgagggccgctctgtggctggtcaggcaatgctgttggtggtcgcagtgaccatcctcattgtagctgtcttcacggccaacacttatgggatgtgggggggggcgatgctgggtgtggcaggcctcctgagccggctggaggaggacaggctgctgctgctaccgaaggaggatgtctgtcgctgggccttggctgtaggcagctgggcttactgccgggccctgcatacacagcgcctccagtgggagtgacagttggatacagccaggcagggtttctgccctgccgaacactttccctcccacctgcctgctcctggcgccttctccctaggggtagactcttctgcctactgaagtgggtttgctgcacattgactggtcaggggcagagtctgggtgctgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaatatgaaaa

SEQ ID NO: 749 - DNA, 2777 bp, Homo sapiens
tcagcagctgccctcactgggcagggcaaattataccgtggcccgaccataaaagccactttccaaaaaaagaagctttaaggcccccgagagacgcagctgagcctctcacctggcagtgcctgactcaggaggtgatgtctgggccatgagccacagagcctggtgtccctttaagcagggagtacaaattctcatccctccctcctgctctccctgacgtcagctggaaggcgtgtgagtgagtgaggggctgaggtaccgcccgcgcgagcacacacagacacacacacacacacacacacacacacacacacacatcttccagacccatcccctgcctgccagctccacgagccagagagagacagagcgcggacgccgcaggaggcagtgcctggaccccagctgcccaggagagacggagcccgtggctggtgaggccgcagagcagggccaggccgggccctgcccgcaaggacgaccaaacccctcaccggcccctgggccccagagcccaccaggctctcctgctggccccaccatgacttcagagtcgacgtcacccccagttgtgcccccgctccactcccccaagtccccagtctggcccaccttccccttccacagggagggcagcagggtctgggagcggggtggtgtcccacctcgggacctacccagccctctgcccaccaagcggaccaggacctattcagcgacagcccgggcctcagctggccccgtgttcaagggcgtctgtaagcagttctcacgctcacagggccatggcttcatcacccccgagaacgggtccgaggacatcttcgtacatgtgtctgacatcgagggggagtacgtgccagtggagggcgacgaggtgacctacaagatgtgccctatccctcccaagaaccagaagttccaggccgtggaggtggtgctcactcagctggccccccacactccccacgagacgtggtctggccaggtcgtgggctcctaggctgagtggttcacaggccagctggccgggggttggggagccacacagggtgaacgggcagcagccggctccatgccccactgccctggctgatgagtccttcggtggcctcagtgtgcacgtctgtctgtccgtctgtgcttgtggctatgagcgtgtgcctccacccaccccacgacccgtgactactgtgcaagctggccaggaggtaggtggagggcaaggccaccagacctggcttcgcgctgtccactgcctctctcctcccctccctgccgcagacacgcaggacccgctcgccctcctgcttacccgtccccacggtgactgagctgcgagagcctgcgctgggctcactccctggcctccgcccctgagctgtcccgtgtcagtccctggcccggagccaggctctctgtgctacttacatctccctcccttggctgaggtcccccgccacagcctggacccttccctcagaagcctggccgatgggtgcttttggggagcctctcagcctctggcaggggaggaggactgacacggaggcacacaggcctctcactgccgaggccagccttccttcctgctctgctctctcagtgccatggagaggcaggaagaggggcctgagggcggaaggggtttggggctcccatttcgccggccagtccctcctcctcagcctggcagtggcgctgggctccttcccctgggctgtactgagccgagcccaggggtttgcagagggtgggggtccatctctccagcttggctgcagacctcctttaccctgactcacaagccccactgatgctctgggccatgcccggctgacggctgctgtggatgccgcgagggacggacacacgtccggggcacccacgaggagggcccccagcctgggagactggccctgcggcctccacgtcaaactctcttcccaaagccctaacagaccagtggccgaggtgtggctcttattgcatccatccctgaagatgtgtggctgttgctgtcacctggagtccttttggggccaagatgtgtgtgcacccggggtcgtggccattcactcccaggcaggggtgagggtggcctggcccaggaggccaggaaggagggccctgtctgcctccacctctgggtgcaccccctgcctaccaccctcccttctagagagcacatcgcctgaccggggagaagtggggccgtggttcgagggagggctggccaggggtgggacccttatgagactcagtctgtgagtaaaactgggggctcaaatgcccaggatgaggggatcagtgactgtctaggaggatcccttgccttgtaggtgccccaagaccgcagggtagaaatcagccgggatgcctgcatcccacccccggccccagggcccaccacataaaatctgggagcccagagctgctgaggtgtggtcagctcccctaaaatgggcacggcccagcctgtcccatgaggaataaaggcccctggcccccttgagagagggcttgttggtgagggctgactcctgggggcccccaaggctcccctcctgtggggaggccaccttttaaggcaccactagcagtcaggatatggtggcatcagccctggggcctcctgggtggcaggggggcagcagctctcctccccactcacaggccctgcagtgctcatttggaattcctcccaagacccctggccacccagaccccccattcttcctaacactggcaataaaccctcaactgtgacccac

SEQ ID NO: 750 - DNA, 1086 bp, Homo sapiens
gtttaggtcggctggaaattatgtcctccgtcggttttccgcagtttttccaccaagcgagatatttttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtatagtccttcaataggaaattgtaattaaaatataattttatagaaccatttttatgtaatctgatttgaatgttatagttgataataataaaatcacttacttggttga

SEQ ID NO: 751 - DNA, 9829 bp, Homo sapiens
aaacaagatggcggctgaaggcgatccggagtggggccccagcaattcggattgagccttctccctccacccgcttccgtcggccgggcccctcccgcccggccccgcgggcctccccacccggccccggcgctccccaccgccccccctgcgcccgcccctcccccttcgctttccttctccccccgcctcggctccgacatgaggggccggcggggcaggccgcccaagcagcccgcggctcccgctgcggagcgctgcgccccggccccgccgccaccgccgccgccgcccacgtccggacccatcggggggctccgctcgcggcaccgcggcagcagccggggcaggtgggccgccgcccaggctgaggtggcgcccaagacgcggctgagctcgcccagggggggcagcagtagccggaggaagccgccgccgccgccgccggccccccccagcaccagcgccccgggccggggggggcgaggaggcgggggcggcaggacggggggcgggggcggcggcggccacctggcccggaccaccgcggcccggagggccgtcaacaaagtggtgtacgatgaccacgagagcgaggaggaggaggaagaggaggacatggtctccgaggaggaggaggaggaggacggcgacgccgaggagacccaggattctgaggacgacgaggaggatgagatggaagaggacgacgatgactccgattatccggaggagatggaagacgacgacgacgacgccagttactgcacggaaagcagcttcaggagccatagtacctacagcagcactccaggtaggcgaaaaccaagagtacatcggcctcgttctcctatattggaagaaaaagacatcccgccccttgaatttcccaagtcctctgaggatttaatggtgcctaatgagcatataatgaatgtcattgccatttacgaggtactgcggaactttggcactgttttgagattatctccttttcgctttgaggacttttgtgcagctctggtgagccaagagcagtgcacactcatggcagagatgcatgttgtgcttttgaaagcagttctgcgtgaagaagacacttccaatactacctttggacctgctgatctgaaagatagcgttaattccacactgtatttcatagatgggatgacgtggccagaggtgctgcgggtgtactgtgagagtgataaggagtaccatcacgttcttccttaccaagaggcagaggactacccatatggaccagtagagaacaagatcaaagttctacagtttctagtcgatcagtttcttacaacaaatattgctcgagaggaattgatgtctgaaggggtgatacagtatgatgaccattgtagggtttgtcacaaacttggggatttgctttgctgtgagacatgttcagcagtataccatttggaatgtgtgaagccacctcttgaggaggtgccagaggacgagtggcagtgtgaagtctgtgtagcacacaaggtgcctggtgtgactgactgtgttgctgaaatccaaaaaaataaaccatatattcgacatgaacctattggatatgatagaagtcggaggaaatactggttcttgaaccgaagactcataatagaagaagatacagaaaatgaaaatgaaaagaaaatttggtattacagcacaaaggtccaacttgcagaattaattgactgtctagacaaagattattgggaagcagaactctgcaaaattctagaagaaatgcgtgaagaaatccaccgacacatggacataactgaagacctgaccaataaggctcggggcagtaacaaatcctttctggcggcagctaatgaagaaattttggaatccataagagccaaaaagggagacattgataatgttaaaagcccagaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgaggtaggtgatttcaaatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtactggtagttaactctcaaggagaaatttcacggttgagcaccaaaaaggaagtgatcatgaaaggaaatatcaacaattattttaaattgggtcaagaagggaagtatcgcgtctaccacaatcaatactccaccaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaactgggcatcacatagggcaaattggatcaaggcagttcagatgtgtagcaaacccagagaatttgcattggctttagccattttggagtgtgcagttaaaccagttgtgatgctaccaatatggcgagaatctttaggacataccaggttacaccggatgacatcaattgaaagagaagaaaaggagaaagtcaaaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccagtaagagtaaaacaaaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccaccacgggaggcacactggttacatctatgactgtgagcaaagagtattccacacgagacaaagtgaaactgatgaaattttcaagaccaaagaagactcgttcaggtacagctctgccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtacagtcttcaactcaaactctttcatcaggacaaactttaaatcaagttactgtttcatccccatcccgtcctcagctacaaatacagcagccacagccccaagtcattgctgtgcctcagctgcaacaacaagtccaggttctctctcagatccagtcacaggttgtggctcagatacaggctcagcaaagtggtgtgccccagcaaatcaaactccagttacctatccaaattcagcaaagcagtgctgtgcagactcaccagattcagaatgtggttacagtgcaggcagccagtgtgcaagagcagttgcaaagggttcagcaactcagggatcagcagcaaaagaagaaacagcaacagatagaaattaagcgtgaacacaccctccaagcttctaatcaaagtgaaatcattcagaaacaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaaattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcgtttttattggtcataacagtccaattatattcttggccaattttgtccaacggacaagaaaaaagcaaagtcaacgacaccattatcttgtcaagatcagatggttttactattgtggcagaagcgagaaaactttgtttattgaaaaaaaaagaaaaagaaagcaagaaaaaaagatactatggggtcaagtgtaactccatggaaatgccacgtctgctcttcagtgaagaagctggtttagagtctcacagaaaacttttgactgtatttatttattgttgcaaaaaagacgcttttttattgctgccctcatttgtcagctaattattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaaatgagtaaaatctatttgaaggtatcttgtttgtaaacatttgtcagattctaatttttttcttttgtattaaaattcaactatggatgtatatgaaacaaaataaatggagataatttttctcccaca

SEQ ID NO: 752 - DNA, 2301 bp, Homo sapiens
gcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagtaagcaaagacttctgtgtcatgtttaaattttttttttcaatccaatacatggaaagccaaaagtttaaatatttaacactgagaactagttggcagtatttcttattcacttgccctttataccgctatattttaaaataattaatggagtttaaattgtgttttgaattatgcctccagtaaaagtactgttttctagcatgtttgttcagtttattaaaatttagctagttaaatttatttaagttatgatagtaccagtattgtccagcaatgtcttgattatttggttttcatacataaagatcttttgagacattgaggatgagttgactgattaaaattttaaaagatctaatgtttcaaaagaatttgggatcttattaaaaggatcttgaattctttcacattcaaacctagatcagtttgagagggggaaaaaacctggtaatctatgtagtcccctcatactaacttggagctgaataacacttatacttgctggtataaatgccttgtgatacagaaggtagataaagcaggaaataataactgttaaaatactatctaagacaggaagcatcatttgtatttcttgacagtttaaatgcttttttctctcatgaatctagtagctgagaaagtaatagaaattgcttggaaaaaaataatgttggccgccaggtgcagtggctcatgcctgtaatcccagcactttgggaggctgaggtgggtggatcacgagtcaggagttcaagaccagcctgaccaacatggtgaaatcctgtctctactaaaaataccaaaataataataataataataatgtatttggatgatatatttgtatgtgaagatgtattcaacaatatctctgcccttgaagagcttgtatttactaacagagaacaaagatgtgtttaaggtataacatggaggtttaagaaattcttacgtatagtttgagctaagcaaattctcagtcgttttgctttcagttttcatattaaatacacacatactttatttcctctactgtttgtatatctccatcttttattgacctgacataaattgctaaccatagcttcatttaaaaatcaaacaaaatttcctgtgtactttagataatattatttcatttgtctgttatcattacaatatattagtaaaagttgcctgtatatcagtattatggaaaaactcaatctttaaatatcagaaaatgaaagatgtattttgtttcctttagtgtagggtatgtaatacccattagcaagcaggcaattcatttgtttaattcaaagattatatttaactctgttgtgacatcagaagccttctttgtcattgtgaatagtcagtggattattttggcctgaatgctgtcatatatgtaacatgttagtaaatcttcctttttacttttctcttttgtatgatgatgatgggtcaacaaaatgagaataaactttttctgaggtttttatttaattaatgctggtagctttagaagactgttattcacttattttatgagaatatatacagtgaaacaaaaccaccagttatttcttcctttccttgtaaagaaggaacagaatgtgggaaacctgtggaattacaatatatttagatgaggcttgggattttttacttttaattttttagttattaacattaatggtttgtaatatttgagtaaataacaaagtactgaaacttgaaaaggataaacttaatttttattgtatttcattttaggaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaataaaa

SEQ ID NO: 753 - DNA, 1511 bp, Homo sapiens
ggcggcggcggaggagtggtgtgtgtgcgagcgtgtgtggctgggggaagccattgcctgtttaatagttgctgttgctgcacttccgcttctctcccagcgagagagagacacgagtggccaggcccagccgcagccgcagcagcagccgccgcggcggcacggaggagccagacacaaagagaggggctgtttgcggggtggggtggggggttcgctatgtcggatgacgattcgagggccagcaccagctcctcctcatcttcgtcttccaaccagcaaaccgagaaagaaacaaacacccccaagaagaaggagagtaaagtcagcatgagcaaaaactccaaactcctctccaccagcgccaagagaattcagaaggagctggcggacatcactttagaccctccacctaattgcagtgctggtcccaaaggcgataacatctatgaatggagatcaaccattctagggcctccaggatccgtgtatgagggtggtgtattctttctcgatatcacttttacaccagaatatcccttcaagcctccaaaggttacatttcggacaagaatctatcattgtaatattaacagtcaaggtgttatttgcttggacatattgaaagataattggagtccagcactaaccatttctaaagtcctcctttctatctgctcacttcttacagactgtaatcctgccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaaca

SEQ ID NO: 754 - DNA, 2076 bp, Homo sapiens
atgatattctgttctcttgggacattacagttttgcatagacaaggtgaacatttctcaaaacaccatgtctctccaattttctaatggatccaggcatgtttgcttaaggtctggagctggatctgtcagacccctcaatggaggtgcaggctttgcaggcagcagtgcatgtggtggctctgttgctggaagtgaattttcctgtgccttgggagggggcttgggcagtgttcctggtgggagccatgctggtggtgcccttggaaatgctgcttgtattggctttgctggaagcgaagggggactcctctctggaaatgagaaggtgaccatgcaaaatcttaatgaccgcttggcatcctacctggataatgtgcgagctctggaggaggcaaatgctgaattagagagaaaaatcaagggttggtatgaaaaatacggacctggatcttgccgtggacttgatcatgactatagcagatatcacctaacaattgaggatcttaagaataagattatctcctccactactactaatgctaatgtcattctgcagattgataatgccagactggctgctgatgatttcaggctaaagtatgaaaatgagctcacccttcaccaaaacgtagaggccgacatcaacggattacggcgagtcctggacgagctgacgctctgcaggaccgaccaggagctgcaatatgagtctctgagtgaggagatgacatatctcaaaaagaaccacgaagaggagatgaaggctctgcagtgcgcggctgggggcaacgtgaacgtggagatgaacgcggccccgggggtagacctcgcggttttgttgaacaacatgcgagcggagtacgaagcccttgcagagcagaaccgcaaggacgcggaggcctggttcaatgagaagagcgcctcgctgcagcaacagatctcccacgactcaggcgcagccactttcgcccggagccagctcaccgagatgaggcgcaccctgcagaccctggagatccagctgcagtccctgatggccacgaaacactccctggagtgctccttgacagagaccgagagcaactactgtacgcagctggcgcagatccaggctcagatcggggccctggaggagcagctgcaccaggtcagaaccgagaccgagggccagaagctggagtatgagcatctcctcgatgtcaaggtccacttggaaaaagaaattgagacctactgccgcctgatagatggagatggaaattcatgctccaaatcaaagggctttggatcaggaagccctgggaattcatctaaagatttatccaaaaccacactggtaaagacagtggttgaagagctagatcaacgtggtaaagttctttcatcaaggattcactccattgaagaaaagacatctaaaatgaccaacggcaagacagaacaaagggttcctttctagctgtcattttagagaaaagaataatttgggaaaggatcctgtacaattgcattattctaaatatcagagagaatatacacactttttacttttaaagatacattacttagcaaaaatacctgttttcttagttttacaggatattgagtgtttgtttccaataaataaaaaagttgatgtgcattcatttccattcactgatgactaataaataactatttgtgatttttttctatgtctcattcatagagaaacacttgtggaatatattttaattgcctttcactgttgttttaaataatagtcaataccgccacatggcatttgaatatgaaacattcactatgcataatctttaaatcacatcgtgtctatgtgggcaaataatcaaaaacttcagaaattctcctgtgactgaaaagtctcaccactagatgacgcattcctggtattttaccaagagcctctctcaaactcttctttccacaatacccaggataccattcctcgtctaaacaggataatctccggaaaaatccacagcaatatggcttgtgttagtgacacttttcctagaacaggggtcagaagctttttttgtgaagacccagatag

SEQ ID NO: 755 - DNA, 2596 bp, Homo sapiens
ctgcttcctgcacgggtggtccccaagcactgcggggccccagcccaaagcggaccttgactaccgcccagccccgcgctcccaggacctcccgcccgcggagcccactcggattgctctccgcccgggtcggcggaggccccgtctcctgtacccggcgctgggactgctccgcaccgcgcggctccctttcagcagctgcgggagcatgcggaggaggccctgccggccccgcgggtcatggaggagttccggcgctcctacagccgcctgtgcagggagagtggggccgagccccaggaggctgtcctgcagcagctgcaccagcttcccaggggccggctggacctggccacgcaaagcctgacggtggagacctgcagggccctgggcaagctgctgccgagggagacgctgtgcacggagctggtcctgagtgactgcatgctcagcgaggaaggggccacactgctgctccgaggcctgtgtgccaacaccgtgctgcgctttctggacttaaagggcaacaaccttcgggctgcaggggccgaggctctgggaaaactcctccaacagaacaagtccattcagagcctcacgctggagtggaacagcctgggcacgtgggacgatgccttcgccaccttctgcgggggcctggcggccaacggcgccctgcagcggctggacctccgcaacaaccagatcagtcacaagggcgcggaggagctggccctagccctgaagggcaacaccaccctccagcagctggacctgcgctggaataacgttggcctcctggggggccgggccctcatgaactgtctccccagcaacagaaccctgtggagactggacctggctgggaacaacatccctggagacgtcctcagagccgtggagcaagccatgggccacagccaggaccggctcaccaccttccaggagaaccaagcccgcactcacgtcctcagcaaggaggtccagcacctccgggaggagaagtccaagcagttcctcgacttgatggagactattgataagcagcgagaagagatggccaagagcagcagggcgtcggcagcccgtgtagggcagcttcaggaagccctgaatgagaggcactccatcatcaacgctctcaaggccaagctgcagatgacagaggccgccctggctctgtcggagcagaaggcccaggacctgggggagctcctggccacagcggagcaggagcagctgagcctgtcacagaggcaggccaaggagctcaagctggagcagcaggaagctgcagagcgggagtctaaactcctcagagacttgtctgctgccaatgaaaagaacctgcttctgcaaaaccaggtagacgagttggagcggaagttcaggtgtcagcaggagcagctgttccagaccaggcaggagatgaccagcatgtcagctgagctgaagatgcgggccatccaggccgaggagcgcctggacatggagaagagaagatgcagacagagcctggaggactccgaaagcctgcgcatcaaggaggtggagcatatgacccgtcacctggaggagagtgagaaggccatgcaggagcgggtgcagaggctggaggcggcgcggctgtccctggaggaggagctgagccgagtgaaagcagcggcactcagcgagcgtggccaggctgaggaggagctgatcaaggccaagagccaggcccgcctggaggagcaacagcgcctggctcacctggaggacaagctgagactgctggcgcaggcacgggacgaggcgcagggcgcttgcctacagcagaagcaggtggtggccgaggcccagacccgggtcagccagctgggcctgcaagttgagggcctgcggcggcgcctggaagagctgcagcaggagctgagcctcaaggaccaggaaagggtggccgaggtgagcagggtgcgcgtggagctgcaggagcagaacggccggctgcaggcggagctggcggctcaggaggcgctgagggagaaggcggcggccctggagcgccagctgaaagtgatggcgagcgaccaccgagaggcgctgctggacagggagagcgagaacgcgtctctccgggagaagctgcggctccgggaggcggagatcgcccgcatccgggacgaggaggcccagagggcgagcttcctgcagaacgccgtcctggcttacgtgcaggcgtcccccgtgaggaccctgagccccccaaagtgagacaggccgggaggacccgggcgcagtaggagtgcatcaggcggcgcccgagatggaccaggggctgcgtcccgcccgcgccgcctctttgagacccgggtcgtctgttccacgcggcggttgcggcgactgttggtggtgtcgcggctgcgggggaaccccgtgggaggcgcctgggaagggctccctaccggccccttcttcccggtcgacgccacgtgggagcacaccgggaaggggtcccgcgggcgcgtctccccctcgccttttgcgatgtcaccgtgaacgctgcggccgcctgcgcgcggcggggtttggaaatacagcgcgtttgcactttgtg

SEQ ID NO: 756 - DNA, 3943 bp, Homo sapiens
agcctggctgaggcagccgcgcaggtcgcagggccagcgtccgcgaggacggcccggctgggcggccccgagctctgtggcgctgtggaggagcgggagcgcggccgaggaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgagcgcgccgggctcccgcgctcgcgagcgagttttgtccgcccggcggcggtggcggggggatggagcccgcgaccgcgccccggcccgacatggcgccggagctgaccccggaggaggagcaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagaaactcgaaggaaggaaggcattgtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagctttgaaactcagaggaatggactggtgtttatctatgacatgtgtggttctaattatgccaactttgagctggatcttggcaagaaagtcctaaacctgctgaagggagcatttccagctcgtttgaagaaggtgctgattgtgggggcacccatatggttccgagtgccctattccatcatcagtctcctcctgaaggacaaagtccgggagaggattcaaatattaaagacatctgaggtcacgcagcatctgcccagggagtgtcttccagaaaacctgggtgggtacgtcaaaattgatctcgccacttggaatttccagttcctaccccaggtgaacggccacccagatcccttcgatgagatcatcctgttctccctccctcctgccttagactgggactcagtacatgttccaggtccccatgctatgaccatccaagagttggtggactatgttaatgccaggcaaaagcaaggaatctatgaggaatatgaagacattcgtcgtgagaaccctgttggcactttccactgttccatgtctccaggaaacctagagaaaaaccgttatggggatgtaccctgcctggaccaaactagagtgaagctaacaaagcgaagtggccatactcagacagattacatcaatgccagtttcatggatggctacaagcagaagaatgcttacattggcacacaaggtcctttggagaatacctatcgtgatttctggctcatggtatgggagcaaaaagtcttggtgattgtcatgaccacccgctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggaacggcagaaacgccaggtgacccacttccagttcttgagctggccagactatggtgtcccttcctcagcagcttccctcattgacttcttgagagtggtcagaaaccagcagagtctggctgtgagcaacatgggagcacgctccaaagggcagtgccctgagccacccattgtggtccattgcagtgcaggcattggcaggacaggtaccttctgctcactggacatctgcctggcacagctggaggagcttggcacccttaatgtgttccagacggtgtcacgcatgaggacccagagggccttcagcatccagacccctgagcagtactatttttgctacaaggccatcctggagttcgcagagaaggagggcatggtatcctctggccaaaacctgctggccgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgctagcctgctagaccctcaaactgggtgggttctgtgtcaataaaaagcttcaccccctggctgagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctttgaatgtgtatattattattttttacaatcatttcattttgtatttaatatcaatggactgagtctgattcagaaaataattgtaatgttcatattcaatatcttacagtgatacagttttgtatttacatataaatataccgacatgatcaaaacc

SEQ ID NO: 757 - DNA, 7122 bp, Homo sapiens
cgctcttgcgggagcgttccgcatcgccccgggggcccctacgcgaggatctccggggccgttggcagcgcctggcacttctgagctcggcggacgagagcctgcaggtttcctccagtcagggacggcgaagggcggaaagcgcaggaggaggcagtgttaggccttaggccgggtgggccgggtcaggagagacgcgcccatctttcgccatccggggtgcgcgaggtcctctcgggacccggccggcgacccgtagctcgggcacgcgcctgtcgcatcccgcaggaaggaggggtccggcctgaggcccggggcggcgtccgccatggagatcccctcggtccagggccggcgcctgggacctggcgggcggccctgaccgccttcctccctgcgcgggctgggtcgcggacgtgcccttcgcggcactcggcctcctctgcgtctccgccttccctgggccgcactgctgcctgggcgcggcggcggcgacggcgccctgttgaatgggctgtgagggcccaggtttaaagcgctggcgaacgcggcctccgggggcgcacggcagctgcagcggtggcgaccaaacgggtgttggagttggcggcggccatggagggcctggctggctatgtatacaaggcggccagcgagggcaaggtgctgactctggccgccttgcttctcaaccggtctgaaagcgacatccgctatctgcttggctatgtcagccagcagggagggcagcgctccacgcccctcatcatcgcagcccgcaatggacacgcaaaggtggtacgcttgctcttagaacattaccgggtgcagactcagcagactggcaccgtccgcttcgacgggtatgtcattgatggtgccactgctctttggtgtgcagctggagcaggacattttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcatataagggacacactgatgtggtcagataccttttagaacaacgtgctgatcccaatgccaaagcacattgtggagccacagcattgcactttgcagctgaagctgggcacatagatattgtgaaagagctgataaaatggcgtgctgctatagtagtgaatggccatgggatgacgccattgaaagtagctgccgaaagctgtaaagctgatgtcgtagaactgttactctctcatgctgattgcgaccgaagaagtcggattgaagctttggaactcttgggtgcctcctttgcaaatgaccgtgagaactatgacatcataaagacataccactatctatatttagccatgttagagaggttccaagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaaggtaacaggaacacccacaaggatcttcttcgatttgctcaagttttctcacaaatgatacatttgaatgaaactgtgaaggccccagacatagaatgtgttttgagatgcagtgttttggaaatagaacaaagtatgaacagagtgaaaaatatttcagatgctgatgtccacaatgctatggacaattatgaatgtaatctctatacctttctgtatttagtgtgcatctctaccaaaacacagtgcagcgaagaagatcagtgcaaaattaacaagcagatctacaacctgattcaccttgatcccagaactcgtgaaggtttcaccttgctgcatctggctgtcaattccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagttcgggctaatgacattaactaccaagaccagatccccagaactcttgaagagtttgttggatttcattaagtgactggatatgtaaagtcgtttaatgtggtgctaaaaagtaaaggacttttaatcacagacagtagaattatgtgttcataaattctgcttttctttccactacccttcctcccatcccatccttccttagttctgtatttgtttttcttgcctcatggtaattgatttcagacagactttaacaaaaccacattgttttggtgtaactataaggtatttgcatattggttacctatttgtctttcttttttttaaaggaacagatataaaatgttttgtttatgtaacaagggacatttataatttcaagttgataatgttttaaacagctgcttacaaaagtatttctgttaagcctatgtcagcatgttatccatgcagcagttttgaggattttatgaagaaaaagagctaaaaaggaacattaagaggaatgggatatccaggtgttctgcacatgccaaactgctgtagatagtttacactcttccattatttatacggagtgatgcagcacattttagcattcaggaggatttttaaaaaatagctgcagattaatctggaaaatgtgctaatttaataatagttacaaatttataaatttaaatccatttgaaattgttgcattatgctgggtagtatatacaaaatggttatcatcttaaaccaacttttcagagaatcttgatggactctgcctttaggcttgaattcttcaaagtctattttaatgaaatttatctaaattgcagcagtctatttgattcagctcatagacatgtaaaaattatgaatgctgttttcttatgaaacaaattgtcacagtgtagttatacattctatttttgtccccttttccctttttctcctgtatcttttaaaatttggaaactacttttccagaaggcattatttatgcctccctaataaggtattttacttatgacagatgaaaaggaaccaggatatgtttgaattttttcactttcttagtctgtgacaagaagtagaaatatcactagtgtggtataggaacttacatgttttttatgatgaaaataattctcaatgccacttgaaaggtaattgtgtctgagagctgcaaatttttcaaccacaaaatgtcacttattcctacaggctatacagaggtctttatggtttttttgttttgttttaatggcaacattgtaactgtcaaactaaaagggtattctgtgattatcttttaagcattacagaaattcaagtgaaagttatatgcttatttctattgatgttaaaaatgataatgaaagcaaaattagctgtatctgtaattttctctctagtgccaaatgaatgccttagctactcatagtgcatggtactgtaagtgaagacctgtagctttttttttttctttaatgaaaagcattataatgatgtagcagcatcagatataaacttaaaaaaaaaggtttcaattaacattttatatatggataatgctttgtaaagtgtaagagaaaggttgcagttggatcagtataaaacaatgaccaagccaaaatcagcaccctagggccttaaataaaatagagataccccacaaaatgaaatattttgaaggatgggaggggacagaaggggggactatcccccaaggatgcaagatactttttacagttgctatcattatactttgtcttcttgcttcagttaggaaggttttgatggtaaattctgtcatggtaatagatacctattttcctaacctgagattttacaaggaaggtttttaggttggcttaaatggaggtatttatttgagtgagccctaatttgaaaattaccagacttgatcctcctggtatgaatcaaggaaatactgtaccttgctcttagcaactctcagtggcctgaaagagaaaatgcacttcttcaaggtgagtgaatcatgctttttccacagttcagatcagaccctttatttttcaaactacaaggcctgcttattggacagtctaaggaatagctttgatacttggtattcagttggttccattattaatgtatattatttttatttaaacatcaaaacttaaaatatcagataatgttgcatgttttaaaaacacatttcatccctttggctacccaggaccagcactatttaagacactgcttatttataaaatgagaataatgattatatgtacatattcagacatcaaaatttaatgacattctattttgagaagggaagacaatgctgaagaaagtaaaactgttgattgaaatgctgacagggtggagaacgaatttgaagacagtggaataaactatgaactatgctaatggtaattagattttttgtttgtttagtatagtggtaaattgtgtagtatcttgctgagaatctaattctatcttgtaaaatcaatccaaatgtgtattgtgaaacacctgtataaaatcatttttgaaataagtgatctacatgcctgtttttttaaaatgtttttggtagaattgtttgaaaatatgtttagccagacccttccccaacttaatttttttttaaaaaaggaaaataggtaagaaaatgatagttctatatctcagccctctgtgaactctaggctgtctccattttgcagccactttggtcatttgatgtttactattggtatacttatgctttgaattgtaaatcttcattgatggtattacagattcaaccaaaacttctctgtcctgttcagtaattgttatataaatctggatgagctagggaggcccaggtggatgttttcattcgcaaatcatgagaaacttaagtgggttttatgcacttgatagagttggcaaaattgaactatgaagttaactatttaactcaaggaatgggcggcaaacccatcccctcgattgataaagaaggggaacatttttacattagaactgacactgaaaacatagctttttcagtccaccctggttgctctagtagcccacagcccaatcacgttaaggttctttgctgtgggaattttaaataaaccaaaccccaaagcagaccatctgtaagctttggtctgcttgtttctgagaagggttttatttcattatactaatagtggactaataattggtaattgtgagaacttaggtatgataacattgtttgaagtaaaatatgatttgggggcagcagctttctaaataccaactctgtttgacaaatgttttgaaaattaaaatttcaagtgagcaacaccctgttaagagttttcactatagttgaggcagctactttatgaataagaccactttgggttatttaagcagaagcgtttcttttttttttttggaatggggtgggatgaggagtgagttgccagacctttgattagtttgctggtttagaaacagccagtggctgaattagtgagtaaatgaatgaaagtataaaggacttgttttttatgatagattttctgtaagaatcttaaatgttccttttcaaattagatgtgttgatgcacacatgactattctgtttttctcactgactatataacattaaaaaggggttaaagaaaacaaaactctgccttttgtgctatgaaatatttttagtccagaggttttaagctgtgtgtccattcctactctgaaaatgcatagctttgttctggatgtcatctcttgaaagtagaaaactcctatgtgtttatcacattgcagggctttcttatgtatttctggcagacttgcccaaatctttagatgggctgggttatacagcatgccctcccccaaataagggatctgaaataaatactacactattgatagtggagatatattaatttttaaaactgtaaagtaaatgtggtctctaggtttgtggtgtgtacctttgtgttaatgtgtagggaagagacagtgacttgatggttatggggagtgtatcttgatgtgtgtataggggtaagtattgctaaattatttacagcttttattcagggtgagtcatgtgatgaatggcctaatcagaaaagtgaaggagcgaagatgcaagcttgccaaatgatgaaatgaacaagattttgtatctattttttatcaggtgttgtaaaatttgtgcatggctttttgttgttgttgcttagtaactggtagaggagaaaagatgaggaaagaaactcagctttcctcacagtcttttcaaaggtacacagttggggagtaaaatctgactggcctaatcgatggaaaagaccctgtccttttcaccccatcctgcaatcctccgtgcagaggaactacactgttgtattctagtaattcactgtgatttataacaaaccggtgatgtcattctattgtgcacttttgtcaaaccatttatgtgactttaataaacatagtaaacttgctgactgcaccagaggtccattagtgatttatatattgcatgacattttctatttgagtttgacatgtagagtcatttttagtttcatggcaattgacagtcctaataactcagctaatttgaaactaacaatcttgctgtgtaaaaggaaaaaatggtgtttgtgttcagtaaatgtttgaaaaaaacta

SEQ ID NO: 758 - DNA, 832 bp, Homo sapiens
gcaaggctcgcagccacctctcgggagtgcagggccagatcctgtgccagcggccttacacggccacagtcggattcgctgccgcagcagccgccacccccaggagccgccgggaccctcgcgtcgtcgccgccgcggcccagatccccacaccatgccgtcggagaagaccttcaagcagcggcgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctgtgcctcccaggagacgttcgggatgaaattgtcagtgtaaaaccagaaaaaatgcatctcttctagaattttttaaacccttaccaaggaaaaaaaaagggatgttaccaactgagatcgatcagttcatctaatcacagatcatcaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaaaaaaaaaaaaaaattgccttacacaat

SEQ ID NO: 759 - DNA, 7295 bp, Homo sapiens
gagcccattagccgcacaaattcgcagcaggcggctggggcggcggctggggcagcggctgcagcagcggcggacgctctgcattacccagtcttgcgtcctcggcaggcgcccgaagctgagtgcgcatcctctaccgcacccaagcttcgtctgtctcgtcaagctcttcatgctgcccaactaaaaggaaaacatgggcacaggggattttatctgcatttccatgactggaggggcgccctgggggttcagattgcaaggtggcaaggagcagaagcagcccttacaagttgcaaagattcgaaatcagagcaaagcctctgggtctgggctctgtgagggagatgaagtggtttccatcaatggcaacccttgtgcagatctcacctaccctgaagtcatcaagctcatggaaagcataacagactctctccaaatgctcatcaaaagaccatccagtggaataagtgaggctttgatatctgaaaatgaaaacaaaaacctcgagcatctcacacatgggggttatgtggaaagtaccaccctgcagattcgaccggccacaaagacccagtgcacagaattcttcctcgcccctgtcaagactgaagttcccctagctgagaaccaaagaagtggtcccgactgtgcaggcagcttgaaagaagaaacaggcccgagctaccaaagggctccccaaatgcctgactcccaaagaggacgcgtggcagaagagctgatcttaagggagaaggtagaagcggtacagcctgggcctgtggttgagctgcaactgtccctttcacaggagagacataagggcgctagtggccctttagtggctctcccgggagctgaaaaatctaagtctcctgacccagaccctaacttgtcacatgacaggattgtccacataaattcgatccctactaatgagaaagcagaccctttcctgaggtccagcaagataatccagatctccagtggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtgggacatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgttgctccaaaacctgcagtcaagtcctcatcctcccaaccagtaactccagtttccccagtctggtctccaggagtggctcccacccaacctcctgccttccccacatccaacccatcaaagggcaccgttgtctcctccatcaaaatagcccagccttcttaccctcctgcccggcctgcaagtactttgaacgtggctggtcccttcaaaggaccacaagcagcagtagccagtcagaattacacacccaaaccaacagtttccacaccaacagtcaatgctgttcagcctggtgcagtgggaccatccaatgagcttccaggaatgagtgggagaggagctcagctctttgctaaaaggcagtcgagaatggagaagtatgtggtcgattcagacacggtgcaggcccacgctgctcgagctcagtctcccactccatctctcccggccagttggaagtactcctccaatgtccgagcacctcctcctgtggcctataatcctatccactcgccgtcttacccactggctgctctcaagtctcagccatcagctgcacagccctccaaaatgggcaagaaaaagggaaagaaacccctcaatgcattagatgtcatgaagcaccaaccgtatcagctcaatgcatccttgtttactttccaacctccagatgcaaaggatggcctcccccagaagtcatcagtcaaggtcaattcagccctggccatgaagcaagctcttcctccccggccagtgaatgctgcctcacctacgaatgtgcaggcttcgtcagtgtactcggtaccagcctatacctctcctccttccttctttgcagaggcctcctcaccagtcagtgcatccccagtgcctgtgggcattcccacctcgccaaagcaagaatcagcctcatcatcttattttgtggcaccaaggccaaagttctcagccaagaaaagtggtgtcacaattcaggagagtgggcgctccctttctcttcctggaagatcagtcccaccccccatttctacatctccttgggtataccagcctacttatagttactctagtaaaccaaccgatggactagagaaagcaaacaagagaccaactccttgggaagcagcagcaaagtctcctctcggtctagtggatgatgctttccaacccagaaacatccaggaatccattgtggcaaatgtggtttcagcagctcggaggaaggtgcttccagggcctccagaggattggaatgaaagactgtcctatattcctcaaacccagaaggcctatatgggctcatgtggaaggcaagagtataatgtcacagccaataataatatgtccaccacctcccaatatggttcacagttgccatatgcatattataggcaggcttcaagaaatgattctgcaatcatgtccatggaaaccaggtctgattactgtcttccagtagctgattacaactacaacccacacccaaggggatggagacgccaaacatgaaagttagaagaacggatcatgtgccaactgtagttttttaaaaaaaacgctcctttgtagggttttaaacttttctaatagatttagattcacttttggtcttggcttgttctcataagtcatttatctaagtttgtgtttctgtgtgtgtgtgtgtgtgtgtatgtatgtgaatatacacacacacacacacacaggtgagtgtgaatacttccttgttggctgatccatagagcattacttggaagaaaatttcactatttgcattgatgtgctggcatttatatgtaattcataattttgattccattaataggtagtctatgcaacaaactctactcaattaaagtaaaactaagtatttcttcattgtaccttagtccaggaagaaattaatggaatatggtgtgctaattatcactacctataacatgaggaatataacattgcagaaatttctcataggggcatgccagtgagcaattactttataaaaatattttccttggtgttaagtatttctctgcaacttttttttttttttttttttttttttgagatggagtcttgctctgtcccacccagtctggagtgcaatggtgcgatcttggctcactgcaacctgcgcctcctgggttcaagcaattctcctgcctcagcctcctgagtagctgggattacaggcatgaaccaccacacctggataatttttgtatttttagtagacacaaagtttcaccatgttggtcagactggtcttgaactcctgacctcgtgatctgcccgcctcagcctcccaaagtgctgggattacaggcgtgagccaccacacctggcctttctgcaacatttttttaaaaaaatctaataaatcttagatttttaaaaaagaattaaaatgtgggagttctcagaaagaaataaacacatgagaataagattattacacattttggaaggacttttgaggaatgatgtgatgtgtagagaatagaaagatttagatatatgcctgtgacaggaatagattctgggttcaggggtccccatctgtcaaatgagaagattggattatctaatcttttagatccttaacaactctgatattctgagattctctcatttgtagaatgcccgctgatgcattgtttattttttttgctcataatataaatatcagattatgtttaggagtggattaggtaattagtgtcactacatgtatcattaaaggtcctaaaaggaattgttaggcggcaggctttgtgttacgtgttacatggagtgagggtagatgtgaagatttaaaacgattgatggatttaaggaagtggtacataaatatgtctgttattatgcaatcgtaggtcatgataatttattcagttatagaaaacatgccacagaagcctatgtaacaagtggtgcttctttagaaagttgtcattagaatgttctgaggaagttaagcagctgcttcatcaatcccatgacacatgccttgttagcatgcccatcaaataatcagatcaaacacctgctccttattgccatacccacgaactgttaaatataaaaaaattcaaagtatttgacatcttaagcaaatatccagaatatttttaagtaaaaaaccatcttaagtattcaaaatttccttggttttttaaaggtgataattttgctttgtgttacttttttgctcttgaatgtatcgttatgatggtctcttataatcatggtatctttcacagaataaaaattaaaaataatgccagggtgcaagtgaccaaggccttatcttgaaagttaaaaaaaaaaagtaaagaaatcacagtaagttctattagtgatgatagaaccagatataaaattgttcagtgatggagaaaagaaacgataaatactttccaaggttatattgttaaattatcttaaattatcaaggtgtaagatgtaatgatcccaagagtttttatagaatcctaaaaaataacgcctgatgtatagattagttagcaaattctcagaaatcccccacataaaagccttactttgttcaaaatttattatagtggtttaatcattttagatttgaatgttttaagataggagagacttagcagaaaatacttggcttgccagggccacgttctacttcattgctttcttttataagtgcaaggagttatttccatcagttgacatagatattattcactaaaattttcagcagactcaaaatagagaggagactttaaacttacatgttagcataaaacagacttctctctcattgcatgcactagatcaatattatcatctgtattaagctatctgaatttattcgagacattaagaaaaagacagtacatggtgggaaagctgcacatttctcacaaggaaaaaaacattctatatttgtagcagaaatcagtggtttgaaaagtcatactttgcagatatgaacctgaaaatcaaagtgccattgttaaatcatcctaaagtgtactgtgggtattctccagcatacttgaaaatgaataaagttagattgctcacattgaagctaatggttgagacaagacacctgccagagtgaagtttgattcctatgggtgagaagatgtagatgactattgttctcactaaagttctaaaataatagcaagtgtagagaagagccgttgctttgaaaatacataccacatttgttataaagcatttgtttgttagtatcaatcacataggtagaaagagtttgagttttactgtggattaaaaagccttccctaaaaagagagcatgccagtcatagagacactaatttggcacttttcctccttcttaggtttaaatgttataccaatgcatgtgtttgaaatatccattaagatgatttaaaatttgtcttgtattttgagtttcttaaatgcgtggattcttgttcatttatctctgaatatgtctcttttatattttggcacaattatacacattggaaagggccaacctattagggctcaagtatgtatatgcaaaaaaaaaaagttatatcaaacaggcacagttattacaactagagagaaattccagaaatatttgtttttttaagagaaagtaaattttcacattagatttctattcaaagtactaatatctacatggtccacacttttctattttaaaaaattgtgttctcttgttaaatagattaacatttccacttctgtttatcacaaaagactgtatttgaaatatgcatacggaaaattgaaattatattagtaataaatgtaacttgaaaaatcaa

SEQ ID NO: 760 - DNA, 1664 bp, Homo sapiens
agagtgctgaaggtcctgccaacggctctcttggcgtctcaacgttcggatcagcagcttttttccattctctctctccacttcttcagtgagcagccatgagttggactgtgcctgttgtgcgggccagccagagagtgagctcggtgggagcgaatttcctatgcctggggatggccctgtgtccgcgtcaagcaacgcgcatcccgctcaacggcacctggctcttcacccccgtgagcaagatggcgactgtgaagagtgagcttattgagcgtttcacttccgagaagcccgttcatcacagtaaggtctccatcataggaactggatcggtgggcatggcctgcgctatcagcatcttattaaaaggcttgagtgatgaacttgcccttgtggatcttgatgaagacaaactgaagggtgagacgatggatcttcaacatggcagccctttcacgaaaatgccaaatattgtttgtagcaaagattactttgtcacagcaaactccaacctagtgattatcacagcaggtgcacgccaagaaaagggagaaacgcgccttaatttagtccagcgaaatgtggccatcttcaagttaatgatttccagtattgtccagtacagcccccactgcaaactgattattgtttccaatccagtggatatcttaacttatgtagcttggaagttgagtgcatttcccaaaaaccgtattattggaagcggctgtaatctggatactgctcgttttcgtttcttgattggacaaaagcttggtatccattctgaaagctgccatggatggatcctcggagagcatggagactcaagtgttcctgtgtggagtggagtgaacatagctggtgtccctttgaaggatctgaactctgatataggaactgataaagatcctgagcaatggaaaaatgtccacaaagaagtgactgcaactgcctatgagattattaaaatgaaaggttatacttcttgggccattggcctatctgtggccgatttaacagaaagtattttgaagaatcttaggagaatacatccagtttccaccataattaagggcctctatggaatagatgaagaagtattcctcagtattccttgtatcctgggagagaacggtattaccaaccttataaagataaagctgacccctgaagaagaggcccatctgaaaaaaagtgcaaaaacactctgggaaattcagaataagcttaagctttaaagttgcctaaaactaccattccgaaattattgaagagatcatagatacaggattatataacgaaattttgaataaacttgaattcctaaaagatggaaacaggaaagtaggtagagtgattttcctatttatttagtcctccagctcttttattgagcatccacgtgctggacgatacttatttacaattcctaagtatttttggtacctctgatgtagcagcacttgccatgttatatatatgtagttggcatttggttcccaaaaagtaggatgtaggtatttattgtgttctagaaattccgactcttttcattagatatatgctatttctttcattcttgctggtttatacctatgttcatttatatgctgtaaaaaagtagtagcttcttctacaatgtaaaaataaatgtacat

SEQ ID NO: 761 - DNA, 1323 bp, Homo sapiens
cgcaacccgggcggcgagatggcgctttggtgtaagcgaggaggacagtacaggacatgagtcctggtgagggacccgaggagcaggacagagaagacggcccctgaatcccatttggccccttgctggctggaggtgtgaaaaccagcggtggaggcagccttcggggcctgcatttgagaataagggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggctgctcagcggaggctgtgctggcccggaagaaacaccgtcggcggccatcgaagcgcaaaaggcactggcgaccctacctggagctgagctgggctgagaaacaacagcgggatgagaggcagagccagagggcctcccgggtccgcgaagagatgttcgccaaaggccagcccgtggccccctacaacaccacccagttcctgatgaatgacagggacccggaggagcccaacttggatgtgccccatgggatctcccacccaggttccagtggggagagtgaggccggggacagtgatgggcggggccgagcgcacggtgagttccagcggaaggacttctctgagacttacgaacgcttccacaccgagagcctgcagggccgcagcaagcaggagctggtgcgagactacctggagctggagaagcggctgtcgcaggcggaggaggagactaggaggctgcagcagctgcaggcgtgcaccggccagcagtcctgccgccaggtggaggagctggctgccgaggtccagaggctccggaccgaaaaccagcggcttcgtcaggagaaccagatgtggaaccgagagggctgccgctgtgatgaggagccgggtacctaggggtgcctcccagcctggtggacccaaggagaaggtcccatttcgtgcacactcaggccagctgggtctcaaggaggcaggtggcagatgaaaaccaccgtcaacaccctgtgcgccctgagaacagctaaatcggttcagactcccacctcaccgtttccatagttggctcttttgtgtcatcttaccctttacagagaaattaaatggccttggtgggaccaaatggg

SEQ ID NO: 762 - DNA, 1444 bp, Homo sapiens; identical to SEQ ID NO: 731

SEQ ID NO: 763 - DNA, 2625 bp, Homo sapiens
gcgacgccgagtttcactctggctgccttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaaggatctggtactgttctggagtggcctgtagcagacactgaaccaccagccagctgcatttgttgtcctggaagtcattgccaactctgccagtcacactggggtccccagagaagtcaagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggagcgaccccgaagccagagccagagccagagcaggtcataaaaaactacacggaagagctgaaagtgcccccagatgaggactgcatcatctgcatggagaagctgtccacagcgtctggatacagcgatgtgactgacagcaaggcaatcgggtccctagctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagcc

SEQ ID NO: 764 - DNA, 2615 bp, Homo sapiens
gactttttgctccaagtgccagaattgattgtggttaggacatcttacgctgagaaataaataaaatggaacataatgggtctgcttcaaatgctgataaaatccaccagaatcgcctgtcgagtgttacagaagatgaagaccaagacgctgctcttaccattgtgactgtgctggacaaagtagcctccatcgtggacagtgtgcaggcaagccagaagagaatagaagagagacacagggaaatggaaaatgccataaaatccgtccagattgacctgttgaagctttcacagtcgcatagcaatacagggcatatcattaacaaattgtttgagaaaacccgaaaagttagtgctcacattaaagatgtgaaagcccgggtggagaagcaacaaattcatgttaaaaaagttgaagtcaagcaagaggaaataatgaagaaaaacaaattccgcgtggtaatattccaggagaagtttcggtgtccgacatccctgtctgttgttaaagacagaaacctaactgagaaccaagaagaggatgatgatgatatctttgatcccccagtagatctgtcttcggatgaagaatattatgttgaagaaagcagatctgccaggcttaggaagtcaggcaaggagcacattgataatatcaagaaggcattttccaaagaaaacatgcagaagacacggcagaatcttgacaagaaagtgaacagaattagaactagaatagtgaccccggagaggagagagaggctaaggcagtcaggagagaggctgagacagtcaggggagaggctgagacagtcaggggagaggtttaagaaatctatttctaatgcagctccctcaaaggaagcttttaagatgcgcagcctcaggaaaggtaaggaccgaacagtggctgaaggtgaggaatgtgccagggagatgggtgtggacatcattgccaggagcgagtctctgggccccatcagtgagctctactctgatgagctcagtgaaccagaacacgaggcagccaggccggtgtatcctccccatgaaggaagggaaatccccacccccgagcctttaaaagttacttttaaatctcaggtgaaagtagaggatgatgaatctcttttgttagatttaaagcactcatcgtaaagaggaattaagtatatcctaaatatgaatctcctaatcatgcagttttagtttgaatagtgtagtcgtctacatttctgtgccatgtaggaaaacataaatgtattttttttcttatatttaaaatcttgaagataatataaatattattatcactctttctcatggcagctgtggattttttagttcctttctcttgtccaccagaaaaatagtttcctaggttgggccagttacgtgtttggtaagggcaactttgcggccgtcatttgcaggagaactctaaatattggttaggattaatattgtggccagcctcaaaggggaataactcatgtgtgggttatatcgtccagatgttcagatcaacagatttgttagtaaattagcagtcacaccccttttttgatgctttcacattaaaaaattgaagttttggacttgagcatttggctctagtatcatagctttacttataagaaaaccctgggcaagtcatctgcttattctcatcagtaaaaatggagagggttggcctctgctgcctgcctcagaggactgttgtgatgatcaaaggaaatggtacacattctgggggaacaagaagcacacccagagaaaacaagcctcatcagttcctccaaaacagaatggaaagagttacaccttctgaaaaagccctcagcaccaatcaataaggtcctaggttggagagaaactaaagctggtcttcagaagccttttcacagaatcaagagtgaaaaataagtaaatgtttgggtgaccactttttcatcagactaactatatcttgggttttagttgggtctcaaaatgttccccagccagaccctttctaatttccttttgattaagatctttggtggactatagcactaaatttgtttaagcagtatgaggcataaaattgtgactatgtttctaaagtcggccctgatgcattgggtttggaaatgaccacaaatattcctgttttcctgagtgtacccttcagggtccagctgtccaaaacagtgttgataggagttcatcatagctgctttgggaggaagccagattctccttatcttttagctttagatcgtggaatccaggaagtagaacaatgtctattgttgctaaagaaagaaagaaatgggccgggtgtggtggctcacggggagtaatcccagcactttgcgaggccgaggtgggtgaatcacctgaggtcagaagttcacgaccagcctgaccaacatggcgaaaccctgactctactgaaaatacaaaaattagctgggcatggtggcatgcgcctgtcccagctactcaggaggctgagacaggagaattgcctgaacccaggaggcggaggttgcagtgagccgagattgtgccactgcactcaagcctgggcaaaagagccagactctgtttcaaaaaaaaagaaaaaaa

SEQ ID NO: 765 - DNA, 1378 bp, Homo sapiens
gaggcaggactgcccggcccagccttggaggaagacttctgggcagaagcggaacacaggagcagagacacatagtcttggctccagtttcgtttcagttatgcccaccctttcagtgttcatggatgtgcccctcgcccacaagctagagggcagcttgttaaagacctacaaacaagatgattacccgaacaagatattcttagcctatagagtctgcatgacaaatgaaggccatccctgggtttctctcgtggtgcagaagactcgactacagatttcacaggatccctccctgaattatgagtacttgcccaccatgggcctgaaatcattcatccaggcctctctagcactcctctttggaaagcacagccaagccattgtggagaacagggtagggggtgtacacactgttggtgacagtggtgccttccagcttggcgtccagtttctcagagcttggcataaggatgctcgtatagtttacatcatctcttctcaaaaagaactgcatggactcgtcttccaggacatgggctttacagtttatgaatactctgtctgggaccccaagaagctatgcatggaccccgacatactcctcaatgtggtggagcagatcccacatggctgtgtccttgtgatggggaacattatcgactgcaagttgacaccaagtgggtgggcaaagttgatgtccatgataaagagcaagcagatattcccattttttgatattccctgtcaaggtttatacaccagtgacttggaagaagatactagaatcttacaatactttgtgtctcaaggctttgagttcttctgcagccagtctctgtccaagaattttggcatttatgatgaaggagtggggatgctagtggtggtggcagtcaacaaccagcagctgctgtgtgtcctctcccagctggaaggattagcccaggccctgtggctaaacccccccaacacgggtgcacgtgtcatcacctccatcctctgcaaccctgctctgctgggagaatggaagcagagtctaaaagaagttgtagagaacatcatgctaaccaaggaaaaagtgaaggagaaactccagctcctgggaacccctgggtcctggggtcacatcaccgagcagagtgggacccacggctatcttggactcaactcccagcaggtggaatacctggtcaggaagaagcacatctatatccccaagaacggtcagattaacttcagctgtatcaatgccaacaacataaattacatcactgagggcatcaatgaggctgtcctcctcacagagagctcagagatgtgtcttccaaaggaaaaaaaaacactgattggaataaaactttagtctttgcaaaaa

SEQ ID NO: 766 - DNA, 2945 bp, Homo sapiens
cgccgcgccgcttcccccacctcgcaccagacctctgaaattgccctcggagactcggcctctcctataaggacgatcgtcctctcagctggagaacaaggccatgcctcagctcctacgccaggcggaagcgggagaggaaggccgacccccaagagcgccccttcagggggtccatccggccttgatctcagatgggggggtgtttgcggagggcggggcatcgcctcaacagctgggggctgcatcatggcaggaacgagtttccctgagccacggagctgcaggtcgcctcctctactaccctgctacccggttacctcttcgcctcttggtcgtcgagcagctccggctcggtcgccgccattaccacatcgcactccgcggcagccgccatcttaccgccgggaccagagagctgggtgggaggccggcggtgaagagcacttccggttggagcatagagcagctccgcggcgccgcgcccagaagggctccctcgggctcgtctaccagagagaggctccgcttggggccagagcggcctcccgcccccggatgtccacggtggtctccgcgccggggcgggagcccaggggctgtgccggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaagaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaaaaa

SEQ ID NO: 767 - DNA, 5032 bp, Homo sapiens
cttgattatgtgtgccctctccgggcgcccgcgttagcggccgggtggaggtggggagggaagacgctgaggaggaggaggaggcggaggaggcggtggaggggaggtggggggaatcagcaaggacatggctcctgactcctgtgcggaacgtgagtgactgagcggcaaagcccgaatggtctctagcgaccggcccgtgtcactggaggacgaggtctcccatagtatgaaggagatgattggaggctgttgcgtttgctcagacgagagaggctgggccgagaacccgctggtttattgcgacgggcacggctgcagcgtcgcggtgcatcaagcttgctatggcattgttcaagtacccactggaccgtggttttgcaggaaatgtgaatctcaggagagagcagccagagtgagatgtgaactttgtccccataaggatggagctttaaaaagaacagataatgggggttgggcccatgtggtttgtgccctgtatattccagaggtacaatttgccaatgtttccacaatggaaccaattgttttacagtctgttccgcatgatcgttataataagacttgctacatttgtgatgaacaaggaagagaaagcaaagcagccactggtgcttgcatgacatgtaataaacatggatgtcgacaggctttccatgtaacatgcgctcagtttgccggactgctttgtgaagaagaaggtaatggtgccgataatgtccaatactgtggctactgtaaataccattttagtaagctgaaaaagagcaaacggggatctaataggtcatatgatcaaagtttaagtgattcttcctctcactctcaggataaacatcatgagaaagagaaaaaaaaatataaagagaaggacaaacacaaacagaaacacaagaagcagccagaaccatcacctgcattggttccatccttgactgttactacagaaaaaacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggcagtttttcaggaactccaggcagtgtaaagtcatcttctggaagttcagtgcagtctccccaggatttcctgagctttacagactcagatctgcgtaatgacagttactctcactcccaacagtcatcagcaaccaaagatgtacataaaggagagtctggaagccaggaagggggggtaaatagttttagtaccttaattggcctcccttcaacctcagctgttacttcacagcctaaaagctttgaaaattcacctggagatttgggtaattccagccttcctacagcaggatataagcgggctcaaacttctggcatagaagaagaaactgtaaaggaaaagaaaaggaaaggaaataaacaaagtaagcatgggcctggcagacccaaaggaaacaaaaatcaagagaatgtttctcatctctcagtttcttctgcttcaccaacatcatctgtagcatcagctgcaggaagcataacaagctctagtctgcagaaatctcctacattgctcaggaatggaagtttacagagcctcagtgttggctcatctccagttggttcagaaatttccatgcagtatcggcatgatggagcttgcccaacaactacgttctcagagttgctgaatgcaatacacaacggtatttataacagcaatgatgtagcagtatcgtttccaaatgtagtatctggctcgggatctagtactcctgtctccagctctcacttacctcagcagtcttctgggcatttgcaacaagtaggagcgctctctccctcagctgtgtcatctgcagcccctgctgttgctacaactcaggcaaatactctatctggatcttctctcagtcaggcaccatctcatatgtatggcaatagatcaaattcatcaatggcagctcttatagctcagtctgaaaacaatcaaacagatcaagatcttggagacaatagccgcaacctagttggcagaggaagctcaccccgaggaagtctctcgccacgatcccctgtaagcagcttacagattcgctatgatcaaccaggcaacagcagtttggaaaatctgcctccagtagcagccagcatagaacagcttttggagaggcagtggagtgaaggacagcaatttttactagaacagggtactcctagtgacattttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactgctcctactactgattccttgaacagcagtaagagccctcatataggaaacagctttttacctgataattctcttcctgtattaaatcaggacttaacctccagtggacaaagtaccagcagctcatcagctctttctaccccacctcctgctgggcagagtccggctcaacaaggctcaggagtgagtggagttcagcaggtcaatggcgtgacagtgggggcactagctagtggaatgcagcctgtaacttccaccattcctgccgtgtctgcagtgggtggaataattggagctttgccaggtaaccaactggcaattaatggcattgtaggagctttaaatggggttatgcagactcctgtcacaatgtcccagaaccctacccctctcacccacacaaccgtaccacctaatgcaacacatccaatgccagctacactgactaacagtgcctcaggactaggattactttctgaccagcaacgacaaatacttattcatcaacagcagtttcagcagttgttaaattctcaacagctcacaccagaacaacatcaagcctttttgtatcagttaatgcaacatcaccaccagcagcaccaccaacctgaacttcagcagctgcagatccctggaccaacacaaatacccataaacaaccttcttgcaggtacacaggcacccccacttcacacagctaccaccaacccatttctcaccatccatggagataatgcaagtcagaaagtagcaagacttagtgataaaactgggcctgtagctcaagagaaaagttgacacctgagaaacatctagaaattgcctatcctgctgttctagcacttcatctggctgcctttgcagtccttttactacagctatgaagaaacgcaacaagaaactcaatgcacaacaaaggattaattgctgcaaggacattcttgtaaggctttgattagttttcttgttgctttgttgcactgaaatggaattcccatgcccctaccccttaccccagttttttgaacatggaaagaaaatttaataactttttaaagtgacataatttacatgcaatatgtttatcaactcaagaatttaatatagttggtacacaactagttttgtttataaattggagatgcaaatagcaaaactaaatacttgctccatttacaaactacttgattttattgtacaagttgaaatatgctcttttgtttgggttacagtatgcttgctctaagtcaaattccaaggaactaatttcttctcctggagttgcattgattcagtattacaaatatatagcacatcacctgggacttggcaatctttgttaaaaaaaaatttcctttctaatgggatttggccaattttggtaatgaagttaggatggtaatgtctgcatctgctaaaggtaattttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgtttataa

SEQ ID NO: 768 - DNA, 5390 bp, Homo sapiens
cagtcagttggtctgggcactgcagcaggctcggctctgtcccagcacttgtctgggagaaaagtggtgttactcacccagggagagtctctctttctaccttccttctttctcgatctccttgtgtgcttttgtgtttctttatttcttttccttttttttctttttttttttttgttacttaattatattcctaatcctggatgaagttgctggattctgcagcacaagtcttcatgaacaagcagcaccgctcagagatttcacggcattcaaaggtcacagaactgccactatggttaaatgtcttgtttaatggttgagaggtgtggcgaaatcttgtttgagaaccccgatcagaatgccaaatgtgtttgcatgctgggagatatacgactaaggggtcagacgggggttcgtgctgaacgccgtggctcctacccattcattgacttccgcctacttaacagtacaacatactcaggggagattggcaccaagaaaaaggtgaaaagactattaagctttcaaagatacttccatgcatcaaggctgcttcgtggaattataccacaagcccctctgcacctgctggatgaagactaccttggacaagcaaggcatatgctctccaaagtgggaatgtgggattttgacattttcttgtttgatcgcttgacaaatggaaacagcctggtaacactgttgtgccacctcttcaatacccatggactcattcaccatttcaagttagatatggtgaccttacaccgatttttagtcatggttcaagaagattaccacagccaaaacccgtatcacaatgctgttcacgcagccgacgtcacccaggccatgcactgctacctgaaagagccaaagcttgccagcttcctcacgcctctggacatcatgcttggactgctggctgcagcagcacacgatgtggaccacccaggggtgaaccagccatttttgataaaaactaaccaccatcttgcaaacctatatcagaatatgtctgtgctggagaatcatcactggcgatctacaattggcatgcttcgagaatcaaggcttcttgctcatttgccaaaggaaatgacacaggatattgaacagcagctgggctccttgatcttggcaacagacatcaacaggcagaatgaatttttgaccagattgaaagctcacctccacaataaagacttaagactggaggatgcacaggacaggcactttatgcttcagatcgccttgaagtgtgctgacatttgcaatccttgtagaatctgggagatgagcaagcagtggagtgaaagggtctgtgaagaattctacaggcaaggtgaacttgaacagaaatttgaactggaaatcagtcctctttgtaatcaacagaaagattccatccctagtatacaaattggtttcatgagctacatcgtggagccgctcttccgggaatgggcccatttcacgggtaacagcaccctgtcggagaacatgctgggccacctcgcacacaacaaggcccagtggaagagcctgttgcccaggcagcacagaagcaggggcagcagtggcagcgggcctgaccacgaccacgcaggccaagggactgagagcgaggagcaggaaggcgacagcccctaggggccggcccaacttagacgcggctctcctccggcagggcccccagagggcagaagcagcgtggaggggccctcacgcagcagcccagccactttctgagtgttgtcctggggctctttggaacgccatcttcctcccacttacctgcctcccctccttttcgcaaatgtacagaagccatttgtcacctcagcattcgctgccgaaatgagcaactccattcagtaacgtgggagctgatcccacgggcaggctctccctgctccaggagaagactaggaggaagaatgaggtgctcctgccgtgtccgccttgttccgggtcgcactggaacaggcagcaattcctaagtccggagcgtttgagcgtttgctatctgactgctgatctgcgtgacagaaacaccagcatatttgcaacgccaaggatattggtcttaagtgcaagagcacaaatgagagtgtgagagaaagtaccttctattttaataataatattattataaaaataataaatctttttaacttttatattttatgcactagacaatggatctgcaactttggactaaggtcattcaatgtacccaaacttgaacagggggttcattgttttgctattgactttattatgccactttggggcagagacttggcatcttcgcagtttaagaaaccacgtttcctatccaatccgaagggaaggtgctgtacagttcattcctttgcaccattagccaatctgtcttttatggattctgtgacatgtttatattcacccatgtacattttctgtaaataccaaacgctactgattcccatgccaaaatacatgagtattatgggattgctacctgtataaacaatggcactgtgaaaatactgttagttttaatacaagagaatgcatttgtaaatatggtatagagtttattaatatactattgtttgcagataaaggccttaactttaaacatctttcatcttctgaaagctgcccaacttaaatcctcatagatgtctttctcaactgccttcccatgttcatctgtatgttttccagctaaggtcacaaaccaaaactgaataaagtctttgaggaaacattttggaaacttcacatgcattccgcttgagaccatagtgtttaatctatggcaccaagcatcgtttcctcagattaatgagacccttcaacaagcctgaatcagtcacttttcaacacagcgatgttttaacaagccagctgctaagcttgtgtttatgtgactcttgttacagatcatggcggtgcgtcagcctcacaggagacatagcaggtctcagaaaccttctatgaccctgtcatctaaccatcagggaattccctgctcccatgccacacatttgtctattatggctatagtaccaaagtacttttggtgtttggttggtgtgcatttctttagtgtcgatagtaactggatttttctttttccttaatctcatgtgaacaactacccaactgtttagctgaagttcatattatttaagtaaagaaaatatttcagttttataacagactttaccttcctggcaggtcattgtagttaattatgtctctagcttggagtgtcaccttggaatttcgttgccattttttctcagacacctggccgtaaaatcagtttgttacagcattcttctctaggctgctaaacgctgtgcattgaaccttttctttagaagtttcagcgtaactaatgttagatgaaaattgttgatgcccctttctttttactttaaacaatgtggtagtgggagaatgactgtttctgccactatcaacctgatcctcatgctgatagaatgacagctagcacttatttcctaagtgcaactgttttagagatttttctcctaacatgcaaaggaaatactgattggcctataataagttcctatagggagactgaggcttgcagaattaaggttcaggggaaattttggaaagttggttgtattttcattgaagtaggagagattatcagatggtgctaaagaaagtgtgaagatcttatgaaataggtggatggtaagttgaaattattgatgtgggtaagaagggaggttgtggaaagttaacactagctttgtatttttttttctgtaaaactgtgaactgatatattttcctttatcactttagtattctgcagttctcagcttggtgaggctccaaaagagaatatgtcagatgtattcctacttccaaacctgtcttactttggtttgatggtacacatagggcttttgaacagtctatttttaatgtatatgaggtcaaatcaaggaaggcaattgctggggacaagaaaagtagaggtaggaaagaagacactattttagctaatggggtttcttgggactaaaaaatggctttgtttaaattataattatataataatttaaataaatgagattggaggtattcttagtagttctgagttgatagtttacattacaattaggtcttgaagaagagctcacagagaaaaaactaccaaatatccaatgggtaagcccatgatgtagccactagtacaataaaaatctgaagtaaaatgaggcataaacttgatgcagctgcctccctcattcaactggggagttcttgagttcctcatttgttggtaaaaagaaaaagaatgtgaaaatgtctctttttttcttggctattagtggctgtcttgcaatatttcaataggagtccaattactagttaaaacactggcggggtgcggtggctcacgcctgtaatcctagcactttgggaggccaagttgggcagatcacaagttcaagagatcgagaccattctggccaacatggtgaaaccccgtctctactaaaaatacaaaaattagctgggcatggcagtgcgtgcctgcaatcccagctactcaggaagctgaggcaggagaatcgcttgaacctgggaggtggaagttgtagtgaactgagatcgcaccactgcactccagcctggcaacagagctagaatccgtctcaaacaaacaaacaaaaaatcccacagctattggatcatccacagattttttctttacaatcttgttctccttgtccatggaccatcaatagttgacttgccaggtttaattctttcattgcttgagaagaaaggaatcaaaggactgtgtgtagtaagctgacggtaaagttaagattaaattaagacagagagagaatacatatcactgccaggcctgataggaaaaatctgctcttccttttaataacagtgatgaattgtcaggaccttatttaggaaaccctgacctacccataactccctgctaggctaagtagaaaccaggttatttctccctgcttatggctccccgcaaagggacttgcagcgtgtcctgcaactttgtcttcagatagtgcttcctacaaaactaggtcttgttttgtaatcttttctcgtgttgaatcagatctgcttacttatttaggtttggttatgagcttgtatctcactgtatttctcatgctttgttcttttaaacaaatcctttaaactgtgtcattttgtatacacatgtgaggtttgaaaaaaaaaaaaaaaaaaaaaagaactaccttgtgagttttgctcaaaatgtggcctaagtagccattggcatgtctagatgaacaaataaaaataaagataatttctttaaaatatca

SEQ ID NO: 769 - DNA, 6535 bp, Homo sapiens
tgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgagtccgagcccgagcccgaacctgaactggtagaagctgaggcggccgaggcttcggtagaggaacccggggaggaggcggccacggtagccgcgacggaggagggggaccaggagcaagacccggagcccgaggaggaggcggcggttgagggtgaggaggaggaggagggcgcggcgacggcggcggcagccccggggcactcggccgtgccgccgccgccgccccagctgccgcctttgcccccgctcccgcgaccgctgtcagagcgcatcacccgcgaggaggtggagggcgaaagcctggacctgtgcctgcagcagctctacaaatataattgcccttcctttttggctgctgctttagccagagccacatcagatgaagtccttcagagtgatctttctgcacattatatcccaaaggaaacggatggcacagaagggactgtggagattgagacagtgaaattggcccgttctgtcttcagcaaactacacgagatttgctgcagctgggtgaaagacttccccctccgcaggagaccccagctttattatgagacatcaatccatgccatcaaaaacatgcgcaggaaaatggaggacaaacatgtctgcattcctgactttaatatgctcttcaacctagaggaccaggaagaacaagcttactttgcagtgtttgatggccatgggggagtagatgctgctatttatgcctccattcacctccacgttaacttagtccgccaggagatgttcccccatgatcctgctgaggccctgtgcagggccttccgggtcactgatgagcggtttgtgcagaaagcagccagggagagcttaagatgtgggaccacaggagtggtgactttcatcagaggcaacatgctacatgtggcctgggtgggtgattcccaggttatgcttgtgagaaagggccaagctgttgaactaatgaagccacacaaaccagacagagaggatgaaaagcagagaattgaggcccttggaggttgcgtagtctggtttggtgcctggagggtgaatggaagtctgtcggtttccagagctattggagatgctgaacataagccatatatctgtggggatgcagattctgcctccactgttctggatgggaccgaagactacctcattctggcctgtgatggcttctatgacaccgtgaaccctgatgaggcagtgaaagttgtgtccgaccacctgaaagagaataatggagacagcagcatggttgcccacaaattagtggcatcagctcgtgatgctgggtcaagtgataacatcacggttattgtggtattcctgagggacatgaacaaagctgtaaatgttagtgaggaatcagattggacagagaactcttttcaaggagggcaagaagatggtggggatgataaggagaatcatggagagtgcaaacgcccttggcctcagcaccagtgctcagcaccagccgacctaggctatgatgggcgtgtggattcattcactgatagaactagcctgagcccagggtcccaaatcaacgtgctggaagacccaggctacctagatctcacacaaatagaagcaagcaaacctcacagtgcccagtttttgctaccagttgagatgtttggtcctggtgcaccaaagaaagcaaatcttattaatgagttaatgatggagaaaaaatcagttcagtcatcattgcctgaatggagtggtgctggagagtttcccactgctttcaatttgggttcaacaggggagcagatatacagaatgcagagcttgtctcctgtctgttcagggttggaaaatgaacagttcaaatccccgggaaacagagtttctagattgtctcatttacgccaccactactcaaagaagtggcacagattcaggtttaatccaaagttttattcatttctctctgctcaagagccttcccacaaaataggcactagcctgtcctcacttactggaagtgggaagagaaataggataagaagttctctgccatggaggcaaaatagttggaaagggtacagtgaaaacatgaggaagctcagaaagactcatgatattccatgcccagatcttccttggagctataaaatagaataatttttctttcaagtaggttagctagctctcccccaataaaaataccactatcagagtagaaacaaggtagacatttctaaaacatatgtgcttcattatgaatccatggatggctcaattcttaaatgtaaatagatctctaggaaactcaaagtacagtgttttcaatctaaaaagaagtattggcagtttcacttgcaaaattacacagctggtccctgtgatgtgtctcgacaccaatacacaacccccttcccaccatccttcatgtcactagatacacaacccccttcccaccatcccttcagtcactagtggaagctttcaagttagttatttcagtcaggatatacagtgttgaaatctcaatgcagttgaaatctggtctgatgtgcctaatttatctgtggaaaatttaatgctgaattacatttggttgggaaatgtccctcaaaatcctgggcactatgaaggaaccccctgccccctcacctttttgggtaggtaaaagactaaaagccatatggattttaactgataacaatgaaagtggtaaatcagtgtaaaagtgtcatattctcagacttgtgaggcggtttatagtcagaaagatttacggatttttttcctgtaacataaaagattgtgaactttttttaattaaaaaatatttcctagggctgtagttatttgggagtttcataacctgttatggtgcttttggtggaaatttttattatttagcattttaggagaccgctgtcaactggttttaatctatgatgctaatgtgttttccactgtaccctcatctcaggaataaaactgctttaacggagatgatgtcaggtacaaatacactatagagtcaaaataccatttacaaagaaaatcaaaagcatttctatattttgtctttttttagttcagacagcaaaggcatgtactactataaaatacaaagtgattttagagaatgaaaaatgctacttttatcttctctaaaattatttcccccaaggtagtgaagtaattggaatgaaggaggctgaaagtattgtctaaagtgagcccagaggccactgagaatgcagattactgacagccaggtctgtttagttgtaattggaagacacatgagtgtcctgcttacatgtagcttcagactgcagagacaggacgtgtgcttttcatttcaatatttagttatatttgatattttgaaactgtctgctttttgctatttctgcagtttcaagttagttagaagcatgttgtcaactaaagacaacaaactatcagattcattcattcagtgaagcagcctctgattctctaagagtcacgaatgtcttagtgttaccctcccctagtcaacagcagaccagcctggccaatgcctatgggtggcccctctggagtgctcactaacaagggtgagtgctctcgctaagaagtgtcccccgcctaatcatgtgtttataggatagtacacgttccccaggcccataacagaggactaaaatctctgaattttaaagacacagatgactggcatattttggataccagtatagctatatcaaatagacaaaaacagcttcactttagcaatgatcagattgttaatctacagattttattttttaaaatttggatgtaagtagagactttcagtatttgttttctcttgattttgaagtcatttcttcttctcacgtctgtgacaaatggttgaaaaggagtcaacatggccccaactatagtgccggaaccttttcatcattctgaggctttgccccacacatggtcctcactcatatctgtcaccttctgaagcctagatcttgttaacccatcaggtgcagtgtcagtttcaaatcaaattatctaagaaaacaagaaaacaaaggcagcagactattggtacacattatagtccaaagtgcttagcgaagtaaaaaaaaaagctttttaaaatttctattgttgtctattggtaatgtttttgatcagaataaagagggtaaagggaaaaagttactacacatgctaggctttctcagtggggaaaaaaatggctggatagaactgggacaaacacagacccatctttaggggtctggattttgtaggtccgactacacagcagtgttaactcatttctcatgccattagctctctacaaaataaagcaaagtagttctagtgtggtcgttataaaccaatattgtgaaaaatagcaactattcatttgttcacaacatgcgtatttatagagtagttaggtaccatttgtaaggtaaatcctttaaaattctataatacatactaaaatagtggttattggtctgatatatgctgctcttggttctataaactagataaaagcagtgctttgtgaaatgcagtgttctctcttaacgccactggtgataggaagtagttcccttcagttcaaatcctgtgcccttatttgctgcttgctgacgtaagcaataagtaaccctctaactaatggtatctacatatttctgtaacttgtatttaatgatggtgtacctggtgattgtaaaaatattagacagatataaaagtatctatataatatctataaactgttaatgctgaggtatagtctgtgaattatgtgttttgtatttttattcattgtgtaatttagtggtggtgaaagttctacactcaatccttaaagagtggcagtatccctttttcaatttaacatggtctgcatcaatctgtttgcctgctaaacaagttagaataggaaatagtaaaataaatccaaacaagagtgtaatattggttagggaaacaaacttcaggtcaccaactgaagtcattacaaactccttgtacattcactgtgagtttcaaagggagtcagtccctaatttacaggtttcctttgttcactttctagatgtgtacttttgagggacatgaggttaggcaacattacagcaacacacactggggctattaatcccatttaggtctgtactaaagaggatgggtagaaacacatatgtatataccttttctttacctagaagtgccatccattgtccttgaattattatgattaaagttactgttgcatttaggaggctccttgaaagtaacaccttttccaaggacaatggcaacaatgtcaatgtcaacactgagtctaattttgaccacatttatagtggtatagtgtcaatactgcattttcatgacaaccacactccactgttgaaacactgtgccagtgagaagtgcaacatccagtgggcagatgaaaatgatgcatggccaagttcagtgtttacagataaaactgctgtggttcaagtgcttccttccccatcaaatccttgataaggctttgtgggaaaatgatctaaattattgttttaatttttaaacctaatttattcactcagtgaacattcttacctaagcaaggctataaaagggaatactacagttttgtccacactttaatttgagaccatttttctttgaatcgtaagttagcaaaagaaatttttttcacctttgaaaatcacgtgatgttaaaggacaaatgcccactcttctattctgatctgcaaatagcttaaatgtctcttgcaaaacaaagtaagataccaccagtattacaacacaatgattttccagacaaatggtatggtgttgaaaaataactgttacttcttaaagcagcattttatcttctattttgaagactatttattgtaataattagaaaacatgaaatagggaactccagactgacacagcagttgtttttgaaaaggaaataaactttgatgaattagataatccagatacatcattgtaaactcttactctaggtgctctttggtgagagacaggctttgttctcttgttcataacatttctctgcaaagaattctctatggagtgaagcgaatgaagtgaataatttcttaccaaataaatttatcaatttacaaatctgctctacatctcacttttgagttcagttgtagtcatgagtgatccttcatattttattaaaagtgttcattcaggtaaggtgtatgttgaaattttgccaattatcttaataaaacctggcaattt

SEQ ID NO: 770 - DNA, 1829 bp, Homo sapiens
gaggcgcgtgtggaagcgcttccgggcggtagcacgctgtgttggcggcggctccccgcttgcctcagctgcagcagcgggaagctcggtggcaagcccttgtagtcctgtgcgatggcgtctcgatatgacagggcgatcactgtcttctccccagacggacacctttttcaagttgaatatgcccaggaagcggtgaagaaaggatccaccgcggtcggaattcgaggtaccaatatagttgttcttggggtagaaaaaaaatctgttgccaagcttcaagatgaaagaactgtgaggaaaatttgtgcccttgatgaccatgtctgcatggcttttgcagttttgacaatttttataggacttactgctgatgctagagtagtaataaacagagcccgtgtggagtgccagagccataagcttacggttgaggacccagtcactgtagaatacataactcgcttcatagcaactttaaagcagaaatatacccaaagcaatggacgaagaccttttggtatttctgccttaattgtaggttttgatgatgatggtatctcaagattgtatcagacagatccttctggtacttatcatgcttggaaggcaaatgcaataggccgaagtgctaaaactgttcgagaatttctagaaaagaattacacagaagatgccatagcaagtgacagtgaagctatcaagttagcaataaaagctttgctagaagttgtccagtctggtggaaaaaacattgaacttgctataataagaagaaatcaacctttgaagatgtttagtgcaaaagaagttgaattatatgtaactgaaatagaaaaggaaaaggaagaagcagagaagaaaaaatcaaagaaatctgtctaattcttaggatgaccactgggaggtcttaatgttttgttttattgtactgcctgaggttgtttagtgaaattttagaggaaaacagttattttgcagcattacatgcagtacttgtgtgatgttttgagaatgccagatctgtggctgtcttcattctattacatagtcaaacataggtttatgtgaagattttctttgaaaggggatttcagtaattgttgagagcagtcataattccacataagcctgagactctataatttgtccagtgtcttacttaccttcatatatgcaaatataattttaaaaaattttttaattaaaaaaatttaataatttggtgatgtttgaatattgactgtcagttaaggacatagctattccaaataaactaaatataatattgagctgcatttctcaaagaatgacaaaagcatccttatactgatgagttcttaaaattttgtcagagccttcttcattttacaatattttgttatttttattttacctttttcattttacaatatttcgttatttttattttacctttttcattttacaagttgcaatatattgtttcgttcatggaacaaatataggctgaattcaaacatgcaattaaagcatgggaagagcttctaagggcatcttaacaggatgctacatgaaaataaggaaagaaattaatacatatcacttttagtttagatttttattttatctcaagtatgtccagtgtgttcggtttgttacatattccatgaaatatctgagtgtgtattttatgattggtattatggaaggcttattgggggaacaagaaaaatataaaaagtgatctctgcccacggaaaggatttaatccaaatggtccacaagaggaatgtgcttaattcctacagtgagtttatatttttgaaaataaaagctagtaaatattc

SEQ ID NO: 771 - DNA, 4595 bp, Homo sapiens
gctcgggaaaggggttcggaaccggtctaggctcaagttaaatctccctctaaagagccaacactggtttctttggcgactcggtttctactctaaacaggtcccgctccacagtctgggcgggcctgtgtgtgcgttgagtagcctctagcgtgaaaacttcatggttaaaagggaagtaccggaggcaagaaatagctttcgaggcactggtttgttagagtagtggtacgtagtgcgccgccctgaacgggggctgagacgctgcttttccagaagtgccagtgaggacgtggcaagaccgcctcggacgtacgcttcctctacctcagcccgtcgggttaggggcgcgggaggcgcagaggctgctgggaacgcgcatgcgctcagcgcggcggggagtccacctttaacgtccgcgggcgcggggtgtgtcgggtgtcgacggcggcgctttgcggccggtcgtgcgggtcgggcgcgggcgggcgcggcggcagtggcgcgcacaggtgattgactggccagctgcctgaaggagcgccaggtcctccttgctggcaggtggcgaagcccattggggcggcggtgcagaccgcggcggcggctgcggcggtctggctcgggaggcgttcctggggccaaggccatggccccgcggctgcagctggagaaggcggcctggcgctgggcggagacggtgcggcccgaggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatcaggatttgttaaagccttgggcctggacactggacaacagcaggatgctcaagaattttcaaagctctttatgtctctattggaagatactttgtctaaacaaaagaatccagatgtgcgcaatattgttcaacagcagttctgtggagaatatgcctatgtaactgtttgcaaccagtgtggcagagagtctaagcttttgtcaaaattttatgagctggagttaaatatccaaggccacaaacagttaacagattgtatctcggaatttttgaaggaagaaaaattagaaggagacaatcgctatttttgcgagaactgtcaaagcaaacagaatgcaacaagaaagattcgacttcttagccttccttgcactctgaacttgcagctaatgcgttttgtctttgacaggcaaactggacataagaaaaagctgaatacctacattggcttctcagaaattttggatatggagccttatgtggaacataaaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctagcagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctgagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcagcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaagcaatggtggaacaaagcggcaaaagatatcccatcaaaattatatagcctatcaaaagcaagttattcgccgaagtatgcgacatagaaaagttcgtggtgagaaagcacttctcgtttctgctaatcagacgttaaaagaattgaaaattcagatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggacatcagacttgaaggaaatgtttccaattttatatttaaggggggtggtgggtgggagggggcaagtaaagacggaacaagtttagtagcagtaatagtaaatcatgtttacatatgagatttatagtcgtgggaggggaataaagttctgttatatttccttgctcgagtttcataccagatgcgttggtccataaaggattgtatcaagtagatgggacaacattctgctctgaacgaaaagtaattttagagacataacctgcttaccaatgcctgtctttgattcatattctactttcaataaagcatgaaagtgaagaacttgtcctaagtgtggaaaagtgtcttcagatttagactcttctccatgtcagctgcagcgccacccgccttacacctgcccggccgtctgtctcttggtattgggtaaaggagggggcacctgcatgtctcctgcaatgagcaaggaattatgtctcatgttttgacttcagaggctttttgctttggtgcatttcagaaaggatggagaacatttattatgtgtgaaagcatcctcttccggttttgctgttattcaaaagtgggaaatgtacctggcacgtttgaaaataaaaaatctgactacctatcagaagagtaaatcaga

SEQ ID NO: 772 - DNA, 4397 bp, Homo sapiens
gtcggtgcctgcagggctctccgtggccgctcgggagaggtgctcttcgctcaggctcccccggagacttgagggggtgcgcgctggcgtgcatggggcctgttctgtccttggtttggggatgctcctaaggggggagaaagggatacctcgggtgcttggaggtcgagagacggatacgtaagtgcgcaagggccactgattagggcacgggaagggctcgctagaatgagctcttaaactggttgggtgtaagcggttttgggctagtctaaaccaaacaactgagaataaacgcggggttcctgcaggttgagagagtacctgtctgcaaatgtccagtagtgatggattgccttgtaggccccagagcaatcggggaagttagcattcttgttcaagaagctgctggttcacttagagctataaaagaatgttgtgagtttggattttcttccaaacgttcaggattgaggttagggctggtggtgagggatcatgtaaagaggtttgagtggctcagccttaggtcccggtgtggaaagcttattcttttggtgtcatcacgtggccgtgggaattatttagaatgtgatctgccctcatgagaagaaaggagctctgaagccgttgcagttcttcctccctatgtggaaaatcgaatttctggaaacatcctccgtattgggagattttgcctatgtaaaggctatccttattggctagcggcactaattactttaaaagtaggatggaagtacaagtatctcaagcatcattgggtttcgagctcacttctgtggaaaagagtttaagggagtggtctagactttccagggaagttattgcctggctgtgtccctctagtcctaattttatacttaactttcccccacctccttcagcctcatctgtttcaatggtgcaactcttttcatccccttttggttaccagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggctacttcttctccagttacttgtagctcaaatgcttgcttggttactaccgatcaggcttcttctggatctgaaacagagtttatgacctcagagactcctgaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagttacatgc

SEQ ID NO: 773 - DNA, 1513 bp, Homo sapiens
agggaggagccggaaactcagggcgcgaggcctgtgggcccagcggtgaggcagcagctgggggcggggggagggcggacctagcttcccagggcaggtgattcgtcggccccggtggcggcggcgcgtgcgacggtcacctcggtttggggaagatggaagagttgagtcaggccctggctagtagcttttctgtgtctcaagatctgaacagcacagctgccccacacccccgcctatcccagtacaagtccaagtacagttccttggagcagagtgagcgccgccggaggttactggaactgcagaaatccaagcggctggattatgtgaaccatgccagaagactggctgaagatgactggacagggatggagagtgaggaagaaaataagaaagatgatgaagaaatggacattgacactgtcaagaagttaccaaaacactatgctaatcaattgatgctttctgagtggttaattgacgttccttcagatttggggcaggaatggattgtggtcgtgtgccctgttggaaaaagagcccttatcgtggcctccaggggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgcccctacatggtgtcagatgtccttggtgtagctgtgccggctggcccgctgaccaccaagccagactatgctgggcaccagctccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagcctccttaaggagccacaggatggtacctggccccaaaaggaatcctggagaggaggacagtgacaacaggtgacttcattctttagagtgaactttccaaacccagtccagctggaaacagcttatctataatctgaaatgctggctcaaacagttatggggaggttcccagattgcgtagcattcagattgatttgagcagctcctactgtgataagtgtatcccagatccacaatgtaaatatatgtgatttgtaagaaagaa

SEQ ID NO: 774 - DNA, 2446 bp, Homo sapiens
ctcattcataaacctctaaagagagcaatcactacacttatggctgggattttgcgcttagtagttcaatggcccccaggcagactacagactgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagcacatacccctcaagttcacaagaatatcccttcagtgaatgcaaaattgaaagtagttaagcatttgataagaatcaagcccttgaagttgccacaaggacttccagcagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagcactttgggaggccaaggcgggcagatcacctgaggtcaagagttcgagaccagcctgaccaacatggagaaacccccatctctactgaaaatacagaattagccaggcatggtggcacatgcctgtaacccagctactcgggaggctgaagcaggagaatcacttgaacccgggaggcagaggttgcagtgagctgagatggtgccactgtactccagcctgggtgataggatgagactccatctcaggggaaaaaaaaaaatttttttttcactgactaaacctgctgcagctctcttttactacagacttggagattttagtttaatttggtttaattctctgtcctttccctttcactgtttcactccaaaacatgtaagaatggcaatgtttgaacatctgcgtttgggtctactgccaccttagcaagcctcattaaccattttataaaaattgcgttagtattgttgttgttgtttttgagacagggtcttgctctgtcacccaagctggaatacagtggcatgatttcagttcactgcagcctcgacctcccaggctcaagtgatcctcccacctcagcctccagagtagctaggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctattttagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgcca

SEQ ID NO: 775 - DNA, 1699 bp, Homo sapiens
tcaggaagtcggcgtgtcgagtggctcttcctggctgctgaggcgggttaaggtctgagggtcttgtggggccacggcgctgatcaccaggtgtttggcttggtcggttcttatttctcgcctggcaatggcgacgtacacctgcataacttgccgggtggcgttccgcgacgcggacatgcagcgggcccactataagacggactggcaccgctacaacctgcggcggaaggtggccagcatggccccagtgaccgccgagggcttccaggagcgagtgcgggcgcagcgggccgtcgcggaggaggagagcaagggctcggccacctactgcaccgtttgcagtaagaagtttgcctctttcaacgcctacgagaaccacctcaagtcccggcgtcacgttgagctggagaagaaggccgtgcaggcagtgaatcggaaagtggagatgatgaatgaaaagaacttggagaaaggactgggcgtggacagtgtggacaaggatgccatgaacgcggccatccagcaggccatcaaggcccagccgtccatgtctcccaagaaggcgcccccagcgcctgcaaaggaggccaggaatgtcgtggccgtgggtactggtggccgtgggacccacgaccgagacccgagtgagaaaccaccccggctccagtggtttgaacagcaggcgaagaagttggcaaagcagcaggaggaggacagcgaggaggaggaagaggacctggatggagacgattgggaagatattgattctgatgaagaattggaatgtgaggatactgaagcaatggacgatgtggtggagcaggatgcagaggaggaagaggctgaggaaggcccaccccttggtgccatccctatcacggactgcttattttgttcccatcattccagctcgctgatgaagaatgtggctcacatgaccaaagaccacagtttctttattcctgatatagaatatctttcagatattaagggactgattaaatacttgggagagaaagttggtgttggcaagatttgcttgtggtgcaacgagaaagggaagtccttctactccacagaagctgtacaggcacatatgaatgacaaaagccactgtaagctcttcacagatggcgatgctgctttggaatttgcagacttctatgattttaggagtagctatccagatcacaaggaaggggaggaccccaataaggctgaggagttgccctcagaaaagaacttggaatatgatgatgaaaccatggaattgattctgccttctggtgccagagtgggtcatcgctccttgatgagatactacaaacagcgatttggcttgtcaagagctgtggcagttgccaaaaatcggaaggccgtgggccgagtacttcagcagtacagagccctgggatggactggcagcacaggagcggctcttatgcgagagcgagacatgcagtatgtccaaaggatgaaatcaaaatggatgctgaagacaggaatgaagaacaatgccaccaagcagatgcactttcgggtccaagtgagattctgagagtctgctgggattgagcaatcatctcctgcccaagtttcctccttgccctgaggaccagtgaaagacagatcataggagagacccttttgctgctacttcattcgttctgacctaataataaaagttagaaccata

SEQ ID NO: 776 - DNA, 3326 bp, Homo sapiens
ggggtcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcctaaa

SEQ ID NO: 777 - DNA, 1665 bp, Homo sapiens
ctcttttcaggctgagtcctaaacctgaagaaagtttagagcctggggctctaaactacctgagtctttccaaacgacaagccaagaagacctgttgaaagtttcctcttaagtttcgtggagagagactcaggtatagaaatatccttactgccacctgacctgaagcagaagaaatcacagacagcttccagaccaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaagatgaagaagaacaaatactagccaaaattgttgagctgctgaaatattcaggagatcagttggaaagaaagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggaaaaaatacttgggatatcacatgaagaagtagactgaaatatcagatttgtcatcaggaatactctttgtctactgtggtcctgtgcacgttggcctcagatggactacaggagattacaacgtacaaggcagatggagcattgacgttttcaaaaccattattcctgtgactggagaggcatcaggagaggtctcgttcgtctccagctcataaaatgtagcagcatcatccttgacagtgatgtttttcaggccctccattgagaacctgaggaaatctgtaaagataagtggtgatgttgtttcaaacgttcagaacagataccatcatcctgcctttgttagctgctgtagggaaagtgcgttacagatgtctgctgacctcacaagagtgaaaagataaactgtgcatgtgtttccacttccgtttctagtactatttatttttaaactacacttggggtggcctaatacctaggaagatgttgctattcacgttagtaaacagcct

SEQ ID NO: 778 - DNA, 3843 bp, Homo sapiens
gttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatggacaaa

SEQ ID NO: 779 - DNA, 6066 bp, Homo sapiens
ccgcgcgcgctcctcgggtctgcgcggagccggcgtcggcgcgcgcttgggcgcctggcgaagaccgagagaggctggcgggatctcagcggcgcggccgcggaacctgaggcggtctggggcggcggcgctccggctctgaagggctccagccaaacggagcccgcggccaaacggtgcctgcggtgcctgagctgagtgaggccgaggccgggaggccgtgcccggagtaaggcgaaagagaatgaaagacgtagataacctcaaaagtataaaagaagaatgggtttgtgaaacaggatctgataatcaacctcttggtaataatcaacaatcaaattgtgaatattttgttgatagcctttttgaggaagctcagaaggttagttccaaatgtgtgtctcccgctgaacagaagaaacaggtagatgtaaatataaaattatggaaaaacggattcaccgtcaacgacgatttcagaagttattccgatggtgccagtcagcagtttttgaactccatcaaaaagggggaattaccttcagaattacagggaatttttgataaagaagaggtggacgttaaagttgaagacaagaaaaatgaaatatgtttgtctacgaagcctgtgttccagcccttttcaggacagggtcacagactaggaagtgccacaccaaaaattgtttctaaagcaaagaatattgaagttgaaaataaaaataatttgtctgctgttccactgaacaacttggaacccattactaatatacagatctggttggccaatggaaaaaggattgtccagaaatttaacattactcatagagtaagccatatcaaagacttcattgaaaaataccaaggatctcaaagaagtcctccgttttccctggcaacagctcttcctgtcctcaggttgctagatgagacactcacactggaagaagcagatttacagaatgctgtcatcattcagagactccaaaaaactgcatcttttagagaactttcagagcactgatttttgatagactaagtggaaaatttgcagagaaatgatggttgtaagtggacatgcaaaccaaaattggggattggagaagtcagactcactagacttttggttcgagtactattgaactctctcctgatgagaagatgtttagataagtacaagttaagaaagtagcatatgactggaaactatattcagtgcactttctccaaaagactacccagaaaaatagacttattttcaaataccagttatcaagatatattaaatagctgtattgtttagaatcttaatatggtataaattagcatatgtattcacaatattcattcagacatcattcccagacagcagggatttatttaaatgttagctgtctgagtttttaaatagctaatacgaccgggtacagtggttcatgcctgtaatcccagaacttcgggaggccgagacaggcagatcacgaggtcaacagattgagaccatcctggcaaacatggtgaaaccccatctctagtaaaaatacaaaaattagctgggcgtggcggtgcgcaactgtagtcccagctactcgggaggctgaggcaggagaatctcttgaacctggcaagtgtaggttgcagtgagctgagattgagcaactgtactccagcttggcgacagagcaagaccccctctcaaaaataaataaaataaagtaaaataaatataaataattgtggccgggtgcaatggctcatgcctgtaatcccagcactttgggaggctgagatgggaggatcacttgaagccaggagtttaaaaccagaatgatcaacagagtgagacccctgtctatatatttttttaatttaaaaaataaaagaataaaattgtgtagctcagtatagtatcaagattaatctgcctactcacatttctacactttataaaaatgtaataaaagaaaattatctttctaaaaagcctattccctttccattttattttctttcaaaaattatggatttgtttttggctaacatttgggattagccattcatttgccaccactcacttagaatataatgccggtgtgtgtcacattactagtattttttaaatgcatcatataaagtatggttttctgtttctttttcgtttgtttgagatggagtttcgctcttgttgcccaggctggagtgcagtggcgcaatctcagctcaccacaacctccacctcccgggttcaagagattctcctgctcagcctcccaagtagctgggattacaggcatgcgccaccatgcttggctaattttgcatttttagtagacacgggatttcaccatgttggtcaggctggtctcgaactcccgacctcaggggatctgcctgcctaggcctcctgaagtgctgggattacaagtgtgaaccaccgtgcccagctggttttctgtttcatacatcagagtcaacttgtgaatacatttaaagattatttcattttgatatcacgaagaaaaacaggctttatatctcagactttaactaaatccagttagacctcaatttttcactgtcagattaaatccccatacctgaaaataagtttaacatttttttttgcaaatgatctattgaatcagatttaaaatgaagcatgcattgagtgtgccaaggaactaagtggtccatagcagcagtaatgttcatagggtgcgagatgcctgctatgaaacagcaactctcaaacatttttatctcaagaccatttgtttatgtgagctatatatattattatattaaatattaaatttttaaaatatttatttatgggccaggcacggtggcttacgcctgtaatcccagcactttgggaggctgaggcaggcggatcacaaggtcaagtgattgagaccatcctgtccaacatggtgaatccccgtctctactaaaaatacaaaaaaaattagctgggtgtggtggcatgcgcctgtagtcccagctacgtgggaggctgagggaggagaatggcttgaacccgggaggtggaggtttcagtgagccgagattgcgcccctgcactccagcctggtgacggagcgagactctttctcaaaaaaaaaaaattattcatttaaaaataacttctggctggacatggtgtctcacgcctgtaatcctagcactttgggaggccaagacaggtggatcacttgagcccaggagtttgagaccagcctgggcaacaaggcaaaactctatctataaaaattacaaaaattagtgcagtagctcacacctgtaatcccagcactttgggacactaaagcgggcagatcacctgaggtcaggagttcgagaccagcctggtcaatgtggtgaaaccatgtctgtactaaaaatacaaaaattagcctggtgtggtggcacatgcctgtaatctcagctactagggaggctgagggaggagaattgcttgaactcaggaggcagaggttgcagtgagccgagattgcgccactgcactctagcttaggcaacagagtaagaccctgccgtaataataataacttttttttttttgagatagagttttgctctttcccccagactagagtgcaatggcgcgatcttggctcactgcaacttgtccccccgggttcaagcgattcttctgccacagcctcccgagtagctgggattataggcgcccactaccacgcctggctaatttttgtatttttagtagagacggggtttcgccatgttggcctggctggcctctaactcgtaacctcaggtgatccgcccgccttggcctcccaaagtgctaggattataggcgtgagccactgtgcccagccaataataacttataaaacatgaaacgatttagtgagaaaagtggccggttttttggggggaattactttctgtcataaagaagatagatgggttctcatgtcttctacattcagtctgttgtgcagtcacatatcatgtagactctggaaaacacctctgtatactggtgaaagaatgaaaagaagcaaataatgccttagtatgattatgaaaaacgttttgacttcacagtgccctgaatgggtcttgggaatctccagggatccctcaggcacactttgagaaccaatctatataaagtgatggttcacaatgattctgaagccttagtttcagaatcatttggggcagcttttcaaaaatgccattcctgccacctaccacaaagattctgattcactgtatctgtgatgggtctcagatctctgcatttttaatctcacgtgattcttaagtatgtggtggaagtacctttcttcaggaaattctgtcctaagcttttaccctgagaaaataaaacctgcatgctttcaccatggacggtgggagactccactgaaacacatctgctagaccactaagtttatccttgtcacccagtttgctcttggaaagagtctgttcccttttgtcactgaaccaatcatgacataaacttgtgctttacctcctatagcacagccgagacaaggctggaacatttaattaaggtttttactaaggactcaggaataacaacagggaaatatctatgtaactagatgacctgacataaaatctatcttctgattgcagtctattgtgagaatgctgcttttcctagctcccagccttccatggggcagaaggctcttttaattaggaagagagggaggacaaaggagagccttttcttttgtccattactcttagaaatgaacaggtacataatagaaaataaataattattgttggtaatgtttacacagcagtgttagagcctctctgtagtgaaacaaaaataatgttcttaccaaaaaaaaaaaaaaaaaaaagaggcaatgataaaatcaatgagcttatctttctgatatagaaaataacaggatgacagttaatacatgttcaggaatctaagaaaatgtttcatataggcctatcatgtagcatttttatttgcataattatagtcaacatatgattctccatgtaggggtctctcattgagaatgtttcctgtgtacctatagaaaagcctctttggtagattttccggtttataattatttaaccagaagatacatgggaggttcttttgtatgtacctgtagaatacatcccagtaagggtcctatggagaaagacctgttgtcatcaataaccttcattattctaactgtgaaacgttcattaatgcgaataatatcctcaaagattttctacaatgagaatcatccagtaaagctttttaactgagaatttaaaagttgtaaaattgttagttaaatgtgtataattatcaaaagaggttgactttggaaaacaaacaatttgctaagggaaggaaaacttgaaaataatcaccttagatggggcatacaatttgacctaagcaattgtttcaaaactgtcttcagtttcttgaaaataattgttagggctgatatatagaaatacatatctaggccaggcacggtgactcatgcctgcaatcccagcactttgggaggctgaggtggatggatcacgaggtcaagagatcgagaccatcctggtcaacatggggaaaccccgtctatactaaaaatacaaaaattagctgggtgtagtggtgtgcgcctgtagtcccagctactcaggaggctgaggcaggagaatcacctgagccccggaggcagaggttgcagtgagccgagatcgtgccactgcactccagcctgggcaacagagcgagactccgtctcaaaaaaaagaaaaaaagaaatacatatctaatgttacagattgtggtttattggttaattactatgcatttttttcagtttaaaaaataatcttattttatatacttctctcggtataatttttcatgacatttcagcatgttgataatatgtgtgcatctatttcagtgccttaaagtattttgagagcaatcttttgctgacagttgaagaactgttaatgaaatactgttcattaaaaggatctgtgaaatca

SEQ ID NO: 780 - DNA, 1223 bp, Homo sapiens
gttccttggagagcttggagccgcgcgccggagggaataggaaagcttggttacaacccgggacacccggagcttcaggatggttcgtactaagacatggaccctgaagaagcactttgttggctatcctactaatagtgactttgagttgaagacagctgagctcccacccttaaaaaatggagaggtcctgcttgaagctttgttcctcaccgtggatccctacatgagagtggcagccaaaagattgaaggaaggtgatacaatgatggggcagcaagtggccaaagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggtatgtaa

SEQ ID NO: 781 - DNA, 3307 bp, Homo sapiens
aaatttcccgggccgggagcgctgggcctgccgggaaggcgctgggacggttacccagcgggccgccggcggtcgtgggcaagcttcgccatgcagagcactgacctaggcaacaaggagagcggcaagatatggcaccgcaagccgtccccggccacgcgggacggaattatagtgaacattattcacaacacttccgattaccatccaaaagttttgcgatttttgaatgtggcttttgatggcacaggcgactgcttaattgctggggaccaccaaggaaatatttatgtttttgacttacatggaaacaggttcaatcttgttcagcgaacagcacaagcttgcacagctctggcctttaatcttcgtaggaaatctgaattccttgtggcattagctgattattctattaaatgttttgatacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggttttctttctaccattaagtaataccatcctcagctgttttaaagataattccatttttgcctgggaatgtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataagccacctccgcctttagtgaaagttattgaagatttgcccaagaataaactgagttccagtgatcttaagatgaaagtaacatcagggagagtacagcagccagcaaaatctagggaaagcaaaatgcaaactagaatattaaaacaagacctgactggtgattttgaaagtaaaaagaatgaattaccagatggattaaacaaaaagcgtttacaaatcttattaaaaggctatggtgaatatccaacaaaatacagaatgttcatttggcgctctctgctacaactgcctgaaaatcatactgcgtttagtaccctcatagataaggggactcatgtggcatttctcaaccttcagaagaaataccccatcaaaagtaggaagctactcagagtattacagagaaccttatctgcattagctcactggtctgtcatttttagtgacacaccatatcttccactcttggcatttccatttgtaaaattattccagaacaaccaactcatctgttttgaagttattgctactctcataatcaattggtgtcaacactggtttgaatattttcctaatcctcctatcaatattcttagcatgatagaaaatgttttggcatttcatgacaaggaactgctgcaacacttcatagatcatgatataacctcccagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgagtttttttttcaccatcggaataacctggatataaatgttgtgattagacaagtttatcatctcatggagaccacgcctactgacattcatccagacagcatgcttaatgtttttgttgcactgacaaaagggcagtatccagtatttaatcaatatccaaagtttattgtggactatcaaacacaggaacgagaaagaataaggaatgatgaattggattacttaagagagaggcagacagttgaagatatgcaagctaaagtcgaccagcaaagagttgaagatgaagcttggtaccagaaacaggagctgcttcgtaaagctgaagaaacaagaagagaaatgctcttacaagaggaggagaaaatgatacaacaaagacagaggctagctgctgtgaaaagagagctgaaagtaaaggaaatgcacttacaagatgctgcaagaaggcgttttctgaagcttcagcaagatcaacaggaaatggaactaagaagactggatgatgaaattgggagaaaggtatatatgagagatcgagaaattgctgccacagccagagacctagaaatgagacagctggaactcgaatcacaaaagagactttatgagaagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcgagagagagacctattttgcaatcagtgacattgatttttagattatttatttaaaattcctataaagatcagccctttgtacagaaaaatgtgtctataaaaattatgtgttatttaattctgatactttttggcttgtaaatggcttcttgaactttttacaataaaaatgttttagaaactgtt

SEQ ID NO: 782 - DNA, 6963 bp, Homo sapiens
gagcgctacccacttccgccccctccccctgccattggaactagctgagccgaactagttgcggccaccgagcagccggctctcggcacctcctcctccgcctccctgtctcctgttccattcgcctttcctcttctttcctggcccacgccgctccgaggcctcgcgaccgccgagcctgcagcctgccccgcggccaacatgagcttcttgtttggtagtcgctcttctaaaacttttaaaccaaagaagaacattccagagggttctcaccagtatgagctcttaaaacacgcagaagccacacttggcagtggcaaccttcggatggctgtcatgcttcctgaaggggaagatctcaatgaatgggttgcagttaacactgtggatttcttcaatcagatcaacatgctttatggaactatcacagacttctgtacagaagagagttgtccagtgatgtcagctggcccaaaatatgagtatcattgggcagatggaacgaacataaagaaacctattaagtgctctgcaccaaagtatattgattacttgatgacttgggttcaggaccagttggatgatgagacgttatttccatcaaaaattggtgtcccgttcccaaagaatttcatgtctgtggcaaaaactatactcaaacgcctctttagggtttatgctcacatttatcatcagcattttgaccctgtgatccagcttcaggaggaagcacatctaaatacatctttcaagcactttattttttttgtccaggaattcaaccttattgatagaagagaacttgcaccactccaagaactgattgaaaaactcacctcaaaagacagataaaaggatgcagagctgtgcaaattgttcctcaaatgaagcagtgtggagtgtattggggattttgttatattttgtttttatctggattgtttttgtcctaggtttgggggcgggggcttgtttgggttcctttttctttattctgattatgtgaaaccatattctattgctaggggaagccaagaaccattctctatacacttgataagggtaaatttatcttagtgtttttaaacttggttttggttacttgaggagttttttaataatattgtgtgctgcaagaaagtgcttgttgattgaactgccgatggattggtttctgtgtggtataaattgtggcccatttatgaagtccccaaaagagttatgtttttaagtgccttggcaggctcacttctgaggtgcaaaacatagatatagaactgaacagggcttgaaacaatattaggattactacccagggcacttactggtgcatgttgtaacatatctatgataaaagccatagtttacctaaaatggtgatttccagcctttactgctttgaagaaacagaatttgtaaaggtatgcatgtagaacataaaaaatatttcttaattattttttatattgatggtaatatattacgttcaacaatgcttaaagctctacaagcaggtcttttcccacctcttgatatctgtgatactgaaacttgaggatgttgaaatgtattacattttggcttctttctacatgttaactgcactgtagatgtaaaaattcaggttatatataggattgccatcttcagaggtgatgctgaactgtgaggtttcctagtaattgccaaatgagccgtaagtctgcagaattcccttctactttgaagagaaggggataggaatgtatatttggctgggggcatggagatgttcgtatgtatgaggagttagggatggggagtcaagttctagaaagttttgtctgaaaacctttgaatagaatggcatgaagattttaatcaattacttataaacaaagtcttagagacttccttttaggaatcaacttccatgagaagttaaaaataaattattaattttaggtacagacattaaacatggaatttaaggactgttgggggaaattgatcacttcttagcatttccattcagtgaatggagctgatgtttgcctgtcattttaagatgataccataccttctttggttattataggtccagtttgaagcattctgacttctggtttttccaccctgaaaggaaatgtttttctttgcagcagtattagataatgaaaaatgctaattcagtagttattaacttctaaattttattcgccatgactttctagtgaattattaccataaataacaatttcagaaacttagtttttagaataaatattaatttttccacttcagttttattctagaaaataccctttttagaaatccagttttagttttgtcattttcgataaatctttcttcagttagaaatatatatccttccttcagttgaaacatatacctttttcacatctaggaagaaatgcttgctctgaaatagtatagattaaaaacactcagtagaaaagaatctaaaattaaatgaatttgttttgccattaaagtagagcagtgatacaatttaatgccattacaattatgttgactagaaactgcctttttctccacttcatttctagcaattatttaccaagtaccaacagtagaagtaacaggaaagcctggcagagttaaatatcttggacatttattggtaaagcttatttataaactgcagtcagagctagttaatttccttaaatctttttgtattcagatagataatatgaatcattatgggttgattcagaaataaaatttgtgaggtgattttgaatcttgtccatataggaaaatgaagcacagaattactcagtcttccatattgtatttgacttcatatcaatctagtaaaaaaggagttgcaatagccaagtatagagagaatagtgaaaaattaatcttgccctttcaagccttatacagtagtacactgtacttgtttttagtagtaagacctactttcccactatatgtagatagtttgttttcactgtgccagaatctcaggtgcctgcttagagtatttctttaatcacagtcactgggaagtaaggagatgtatatatgtgtatatatggtaacaaagcatagcagttctctaggggagaggcctggcattgcacatggtgttacatggctacaagtaaggaaaaaatcagaaagtgaaagaactgatgtaataaaaggttgatttggttggttcccatgaaagttagtaagatgcccttttaaatataaggatcagtgctttgttctgcagcagagtttgctgataaatgtctgttggattctttttggatttctttaattaatttgtaagtaaccaagataattattttcccccttgctctctatattaatacgtagctataaagcaacagttggttttcttatcctttgataaaagcatcccataaaatataaagtagtaagttaacatagtattattgtcacacacaatgctttttttggttaaatgttgatacgaagcaatgttttggaattactttaattgatggagtagtggtggtagagagaaattaataacaaaaagagtgaaaatattttaattagcagtagatggtgctactggctttcatttgctgacttgattattccctttctcttaaaaaccatggcattagactgcactaaattaacaagcatgttagttgctggtagaggttttggaggttaatttaccttaaattggaagacttttaattgcagtctctttctaccttccctctgttagtcatttgtaaattctaaatggtcaccataaaatgtattaggtaggagaagatacgttttatgtataatatatctcagactgagttactgcctgtcttatcaggatggataaaacactacagtctcttatcaggaaatagagatgatgtggatatttatatattacatatataaccaccagactccattttatatattagcattttccttgcttatgggaaaatagcaaaacaacatttcatttatacttttgtttacccctctctgagacaggttttgataaccactgaaatggtagaatatgtgagatacaaatattgagttgtagaactttctttttaaggtgaataagtcatgccttaacatccaaataagagttcatcttcagagtggttcttttgggagcactgtttattccagctatactgcaaaagtataatgtttttggaactgttctagagcataccatgaaaagcagtttgttattatgcaggaaaatcagtttcatcattttagttacactaaacacttttggcagcttaatatgacctttttaaattttttttattttttttatttttatttctttaagatggagtcttgctctgttgcccgggctggagtacaatggcatgatctcagctcactgcaacctccacctcctgggttcaagcatttctcctgcctcagcctcccaagtagctgggattacaggcagcaccacacctggctaattttcatatttttagtagagatggggtttcaacatattggccaggctggtctcaaactcctgacctcaagtgatccgccctccccagcctcccaaagtgctgggattacaggtgtgagccaccacagccagccagtatgacctatcttaatcatcagctcaactgtaatttaaatttggctgttctctggagctaaaccattagggaagttcaaaggaatgtgccatgatttccgaatttgcacaagagaatgttttaagcattggtagcataattgaataaaagaatagtttcctgatgtcactattttgaagtggaaattatcacttggatgtggaggttttactttttaaaaacattcagcttaattaccttaccttaattaccttagttagatatactaatggaaaaaaaccaagtcctttctctagaacttgttttctatttttgttccttttcatgaaaacttctcaatttaattttaactactgtaggatagtattgattgaatggatactatggaaaagtggatccaatatttaagatagaagtagtttaaggagacaacagcctttactgccatttttttttaaatgttttcactcagatgaacaatttgactttaataaaagactggagatttttgtacaaagaaataggaataagtttcatatactaattatgctgagttttaagcctacatatcacaaaatatttagaattgtataaccttttcatatatttataacttttaatgtctttttaaaagatgtgggaccaaaaatatatttataatttggaaatgtgactgcataccaataagaaaacttaccttattttgaaatttatctgggatattaaagaatctaccaattcttaaaaacacagatttatactttaagcttattttaaaattaaagaatatataccaattcttagaaacactttaaggactactcttaaataacttaaatatcagagttttgttgtaatattaaaatttaccgtggaaatcactgttgttcagctatcaccttaattgtgtatgatatgataaatgtttagcagtaaagctatcttaagatttaatggaaaagtttaatttgaagatgtaacaaaaattctgaccacagttgattctgaatttttaaggctttcctaataggctgatcacagagaataatccattttgaaggtataaaactgcactgtatgtctgtcacttgtagctgaactgattcacattttgacaaaagagagaaaatacaaaaatgagttttgcaaatgtaataactttttctgcatatagaactaaataattgaaaaatatgggctatagttctcaaaggtagatagtaaaatcactggctttttccagctgtatgtttttccactgtgcgtgtacacacacactggaaaataattaggctgattttgcaggtcttcattgttagagattctgaagtatttactgtcaattcataggtttcagtttatttaggaaattagtgtttgacagctttttttaaattatttcactgaagctgagattattagtgatacaaagttaaaatttcaatatttaatttctctatatattattaatattaaattgttttttacttataaattcatgttctcatctgatttaatattaaatttgtataggtgggcgtttcttaccattttgcacaagtttttgtttttctgaaatacttaattgtgcaggttgtaaaaaagattagtgcattttcattttaaggatgctttgctccttaaattgttcgacagaaatgactttttagggaaagtagtttttttggagctactaacttgtatttattattgtacatgcataaccagggtggtgagggcactaatcttgtaggaaacacttacttgatgttttatttgaacttttcctataggtttaacttttactgcatagaattaacactaggaacagtgtcatgaaatctgggttgaaggagaatacagtatatatgagaacacttaaagttcaaatagaaatcatttctgaagacaaaagcagaggaatattgtcagtgccaagtaatggaagaataagggcggcatttacactgtgcaagtattgagaagagtgcataaagacagggaactactctcatggagacagtttctctcttataatcaagtaactagaaggggaaaaatcatctaagttatgaaatccaacataggcgctatattacaaactgtgccggattatgcaaattgtagttgttactgatcaaagtttaattgcttcatttttgtttaaaaagggatactgatgtcagaaaatctgtaatatgttttattcaaaagatgtaaataatgtatacagacttgtatgtgatgggatgggaaatatttaaattctaggtgtttttttttttttaaagaagaaactcaatgtttataagaaaaaaatgaataaatagttacgtttggccatgaa

SEQ ID NO: 783 - DNA, 624 bp, Homo sapiens
tagggggcgcggcggggcggggcgcacctttcggcgggcctcgcggatggcggcgcagggcgtagggcctgggccggggtcggcggcgcccccggggctggaggcggcccggcagaagctggcgctgcggcgcaagaaggtgctgagcaccgaggagatggagctgtacgagctggctcaggcggcgggcggcggtatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagagacaaaggcagcgctgccctcgggggagtattggccctggcggaacgcagcaaccacgagggatccagccagaggatgccacgccagcccagcgctaccaggctgcccaaggggggcgggcctgggaagagccctacgcagggcagcacctaggatggggcagagacttgtcacatctttgtccccagcaaaggctacatgttacctccttcagttgataataaacctttctgagatgcagagggtccaggtca

SEQ ID NO: 784 - DNA, 1949 bp, Homo sapiens
aagatggcgatggctgcggtagcagcggcggcggctgttgcctggcccggtaccctggggacgggggccgagtagcgccttccccgggccccgtgaaccggctgcgggtcgcccttggggggcagcggccgcagccccccacctgggccctcggtccgccctcccggcgcgtccatgaactcagtgtcgccggccgccgcgcagtaccggagcagcagcccggaggacgcgcgccgccggcccgaggcccgcaggccgcggggtcccagaggcccagaccccaacggcctggggccttccggagccagcggccccgctcttggctctcccggggctggcccgagtgagccggacgaagtggacaagttcaaggccaagttcctgacagcctggaacaacgtcaagtacggttgggtggttaaaagccggaccagctttagcaagatctccagcatccacctctgtggccgccgctaccgtttcgagggcgagggtgacatacagcgtttccagcgggactttgtgtcccgcctgtggctcacataccgccgggacttcccgccccttcctgggggctgcctgacctcggactgtggctgggggtgcatgttacgcagcggccagatgatgctggcacagggccttctgctgcatttcctgcccagagactggacatgggccgagggcatgggcctgggcccccctgagctgtcagggtcagcctctcccagccggtaccatgggcctgcccgctggatgcccccacgctgggcccagggtgcccctgagctggagcaggaacgccggcaccggcagattgtgtcctggttcgccgaccacccccgggccccctttggcctacaccggctggtggagcttgggcagagctcaggcaagaaggcaggtgactggtatgggccatcgctagtggcacacatcctcaggaaagccgtggagagctgctccgacgtcacccgcctggtggtgtacgtttctcaggactgcacagtgtacaaggcggatgtggcacgcctggtggccaggccagaccccacagccgagtggaagtctgtggtcatcctggtgcccgtgcgactgggtggcgagactctcaaccccgtgtatgtgccctgcgtgaaggaactcctgcgttgcgagctgtgcctgggcatcatgggtgggaaaccgcgacactcactgtacttcattggctaccaagatgacttcctgctgtacctggaccctcactactgccagcccactgtggatgtcagccaggccgacttccccctggagtccttccactgcacctcgccccgcaagatggcctttgccaagatggacccaagctgtaccgtgggcttctatgctggagacaggaaggagtttgagacactctgctcagagctgaccagggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctctggcagtgatgatggtacttcctgttgtcagcccctcaagcccagctgcaaccagtctggggccattcagccagggacagagcccacagagcccatacacctgtctcccaccagcggggccctcctggcagggtagggaaggaggaccccgggcacccccctcagggcctgactcacgtactgtagtttgcactggacgcccgggccctccctgtcccaaagcccccttgggggaactgtggctgctgggggccaataaagctgtgtaacttg

SEQ ID NO: 785 - DNA, 1912 bp, Homo sapiens
ccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggttgctgcagcaactggtcacacagtagtgttggtagaccagacagaggacatcctggcaaaatccaaaaagggaattgaggaaagccttaggaaagtggcaaagaagaagtttgcagaaaaccttaaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgaacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaagccctaggaaagcatcctgtttcttgcaaggacactcctgggtttattgtgaaccgcctcctggttccatacctcatggaagcaatcaggctgtatgaacgaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaagcta

SEQ ID NO: 786 - DNA, 2337 bp, Homo sapiens
cgagggagtccagagccttgagcccggtgctcctccctcgcgcagcggtggctctgcggccgctggagtaaacactgcctttgttccctagcgcctcgtctttcgtcgccccgtgccctcacgccgccgggctctggccggcccgccctcggtccttgaaccccatttcggctcgtgccgtgcggatgcagctgccgggcctgggtttgggcattgagcgggaggaggaggaggagcggcggcgcctgggcggcatgcgatggggaactgctgctggacgcagtgcttcggactgcttcgcaaggaagcggggcggctgcagcgagtaggcggcggcggaggatccaagtattttagaacatgctcaagaggtgagcacttaacaatagagtttgagaatctagtagaaagtgatgaaggggagagcccaggaagcagtcataggcctcttactgaggaagaaattgttgacctaagagaaaggcattatgattccattgccgaaaaacaaaaagatcttgataagaaaattcaaaaagagcaagaaaggcagagaattgtgcagcaatatcatccttccaacaatggagaatatcaaagttcaggaccagaagatgacttcgaatcttgtttgagaaatatgaagtcacagtatgaagtttttcgaagtagtagactctcatcagatgctacagttttgacaccaaatacagaaagcagttgtgatttaatgaccaaaactaaatcaactagtggaaatgacgacagcacatccttagatctagagtgggaagatgaagaaggaatgaatagaatgcttccaatgagagaacgttccaaaacagaggaagacattctacgggcagcacttaagtatagcaacaagaagactggaagtaatcctacatcagcctctgatgattccaatgggctggagtgggaaaatgattttgttagtgccgaaatggatgataatggaaattccgagtattctggatttgtaaatcctgtattagaactgtctgattctggcataaggcattctgacacagatcaacagactcgatagggtaaaattgtgtgaccttgtttatcagttatgaccaaatgttaaaaaccaactagaatgtataagtgattgtgcttagcctttttgtaagggagatgtgtaagaaaccatgttgtaaatgcttattttattacaaaggagtagggatgataggatctgaattgatacagaattaagtgcaatttcatcatctgccttctgcttttcaagaccaatttaatggtcctgtcatgttactgattaaatttactttgtcttgtctttatagcatttctgtttactatggtagatttccactttcaatttttaaaattaattttactttgaatgatttatgaagcctatttcattgtctaactatgaaaatattaagacttttttgttaattctcagccgatgtgaaggaagcatgaggagggatcgtcagattcagatttagaatagtgttcccgtttccagcattatttatttctatgacttctttggattttattatctaatagtaagtacagttgatgtgggtagatgactctaagaaatgctgaagtatcggcattacatgtgtttatttacatgtcctagtatgataatgttgattcaatctgaacaaaagataatataaaaataacccttcagagtttggacatttcaagttggtaataataaaaaataatatttaagaagatatatatatatatatatttagttttttccacttcattttacatgccactatattgactttaattgatatacagtattaagtttttaggtgccattatttttaaaaaattctatatttccaatgaacgatgttagattttacacagaacatattctctgcatgatttcagaaaagaaaatctaaaaaggtaatacgggtatttcaaataaaatcctttctggtatgaaaggctccattgattttattaagccttcctttaccttgtagtacaaggtgctttaatgggatagaactaagcatatcaatatctataactgcattttgtgctagacaattactgttcttttctctaaaatgtatatgtcaatttacaaggccagggatagaaaacactccataattgctttccttgattttgctgaggatttggtatgattttagtaagcaaactgttttttggtttttccttaatgtttttaattttttttcctcttgcaacaatgacggtgcatgttcttataaatataggaaggtccagatataaatagtaacctaaagttcttgctgtgcttaaaaaaaaaaa

SEQ ID NO: 787 - DNA, 1619 bp, Homo sapiens
attggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaaaccgctc

SEQ ID NO: 788 - DNA, 1038 bp, Homo sapiens
taagtgtacatgcttaggccttctgaagcagcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttcaggttttgtcacaaggatccttgttagaaagtccaagttacacagtttgtgtctctgagccagataaagatgatgattttctttctctgaactttcccaggaaactttggaaaatagtggaaagtgaccaattcaagtctatttcatgggatgagaatggaacttgcatagtgattaatgaagaactcttcaagaaagaaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaagatacgcttcaccaaaatgaaactttccagatcttcaacttatgaaaacaggtatttatgttgcaacttacatttaaaagatgagtcgaattactcataatccttagaagttagcttgtccgcatctgaaaattcacttttaccttgaagttcaatctgtctctgggaaagactagattggaagaataaaattcaagaatgtgatgttttagtaatggaaaagccaagagcgtcaggtggcaaaagtccttctgttactcaagaaaatgctctgaaaaattccttttctcttttttttttgtaaagattaactccacctcaccaccacaatgaggtatttttctcagcaattgacacctgtttactcagttactccctgtaactatgttatgctgtgaagtaggcaatacagttgttaaagaagaataa

SEQ ID NO: 789 - DNA, 4326 bp, Homo sapiens
ctgccaacccgcgagcccgcatcatggatgtcgagctcccctatttcgcattgctagccctggaattcgagaccccagacgaggaccaggattcatgaaatcagtcgcaggggccggggcaggggcctctggctcccgacactggccgagaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgctaaagtggataatgagatccttaattacaaagacctggcggctctccccaaggttaagtctatctacgaggtacaacgccccgacctcatttcctatgagcctcattccagatacatgtccgacgagatgctggagagatgtggctatggagagtcgctgggaacattatctccctactcccaggacatctacgagaacctggacctccggcagagacgggcctccagcccggggtacatagactcccccacctacagccggcagggcatgtcccccaccttctcccgctcacctcaccactactaccgctctgggcccgagagtggccggagctctccataccatagccagttagatgtgaggtcctccactccaacctcttaccaggctcccaagcactttcacatcccagctggagacagtaacatctaccggaaacccccgatctacaaacggcatggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatacccccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatggggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 790 - DNA, 5714 bp, Homo sapiens
agctgattctatcacattgtaagatgcctttggataattctacagtcctcttaaatgaatctttagaacttggcaagtctcactagataccttcaatcatcattttgagctcaaagaattctgagacttatggttggtcatatagaagagtaccttgaacctatagtttcctgaagaatcagtttaaaagatccaaggagtacaaaaggagaagtacaaatgtctactacaagacgaaaacgtagtatgttatgttgtttaccgtaagctgtagtaaaatgagctcgattgttgacagagatgacagtagtatttttgatgggttggtggaagaagatgacaaggacaaagcgaaaagagtatctagaaacaaatctgaaaagaaacgtagagatcaatttaatgttctcattaaagaactgggatccatgcttcctggtaatgctagaaagatggacaaatctactgttctgcagaaaagcattgattttttacgaaaacataaagaaatcactgcacagtcagatgctagtgaaattcgacaggactggaaacctacattccttagtaatgaagagtttacacaattaatgttagaggctcttgatggtttttttttagcaatcatgacagatggaagcataatatatgtgtctgagagtgtaacttcattacttgaacatttaccatctgatcttgtggatcaaagtatatttaattttatcccagaaggggaacattcagaggtttataaaatactctctactcatctgctggaaagtgattcattaaccccagaatatttaaaatcaaaaaatcagttagaattctgttgtcacatgctgcgaggaacaatagacccaaaggagccatctacctatgaatatgtaaaatttataggaaatttcaaatctttaaacagtgtatcctcttcagcacacaatggttttgaaggaactatacaacgcacacataggccatcttatgaagatagagtttgttttgtagctactgtcaggttagctacacctcagttcatcaaggaaatgtgcactgttgaagaacccaatgaagagtttacatctagacatagtttagaatggaagtttctgtttctagatcacagggcaccacccataatagggtatttgccatttgaagttctgggaacatcaggctatgattactatcatgtggatgacctagaaaatttggcaaaatgtcatgagcacttaatgcaatatgggaaaggcaaatcatgttattataggttcctgactaaggggcaacagtggatttggcttcagactcattattatatcacttaccatcagtggaattcaaggccagagtttattgtttgtactcacactgtagtaagttatgcagaagttagggctgaaagacgacgagaacttggcattgaagagtctcttcctgagacagctgctgacaaaagccaagattctgggtcagataatcgtataaacacagtcagtctcaaggaagcattggaaaggtttgatcacagcccaaccccttctgcctcttctcggagttcaagaaaatcatctcacacggccgtctcagacccttcctcaacaccaaccaagatcccgacggatacgagcactccacccaggcagcatttaccagctcatgagaagatggtgcaaagaaggtcatcatttagtagtcagtccataaattcccagtctgttggttcatcattaacacagccagtgatgtctcaagctacaaatttaccaattccacaaggcatgtcccagtttcagttttcagctcaattaggagccatgcaacatctgaaagaccaattggaacaacggacacgcatgatagaagcaaatattcatcggcaacaagaagaactaagaaaaattcaagaacaacttcagatggtccatggtcaggggctgcagatgtttttgcaacaatcaaatcctgggttgaattttggttccgttcaactttcttctggaaattcatctaatatccagcaacttgcacctataaatatgcaaggccaagttgttcctactaaccagattcaaagtggaatgaatactggacacattggcacaactcagcacatgatacaacaacagactttacagagtacatcaactcagagtcaacaaaatgtactgagtgggcacagtcagcaaacatctctacccagtcagacacagagcactcttacagccccactgtataacactatggtgatttctcagcctgcagccggaagcatggtccagattccatctagtatgccacaaaacagcacccagagtgctgcagtaactacattcactcaggacaggcagataagattttctcaaggtcaacaacttgtgaccaaattagtgactgctcctgtagcttgtggggcagtcatggtacctagtactatgcttatgggccaggtggtgactgcatatcctacttttgctacacaacagcaacagtcacagacattgtcagtaacgcagcagcagcagcagcagagctcccaggagcagcagctcacttcagttcagcaaccatctcaggctcagctgacccagccaccgcaacaatttttacagacttctaggttgctccatgggaatccctcaactcaactcattctctctgctgcatttcctctacaacagagcaccttccctcagtcacatcaccagcaacatcagtctcagcaacagcagcaactcagccggcacaggactgacagcttgcccgacccttccaaggttcaaccacagtagcacacgtgcttcctctcttgacatcaagggaggaaggggatggcccattaagagttactcagatgacctgaggaaaggagggaaagttccagcagtttcatgagatgcagtattgagtgttctagttcctggaattagttggcagagaaaatgctgcctagtgctacagatgtacattaaataccagccagcaggaggtgatcataggggcatagccagttctgacagtgttttaggtgcctggatattttttgatggaaaaagaatatattgccaaatattaagaagctcagctatgaaatgacctccagggaatcagaaaggcactaatgatgttagtaacttttagtggttctgtgcctcttatcaagtgttacagaggacataccactgccatgtcaggggtttgcttacagtgatgccatgaagacagtccagtagacttggtagcgaccccctcccccaacccctctcccttttcagataatgatggaacagtaattactttcagaatgttgtgtgggttcaaattctctatgtacagatgatgtaaaaatatgtatatgtctagataaaaggagagaaagcaaaacattttgtatgctgcatgaaagcgttatctcttccttacaggtgtgagcacctttcctgaaattctgacaccatgtgcaaactgatccatcctgtttttccttttgtttacaacacagtagtgttctgttcacttttccggggcacaagtttttttgttcatactttggctgtgatgtcacagtttgttcagtgaggtatgatgtgctgctgggaatggattttttttttcaggttaaattattgatacaacaggattttcaagttattcagaaatatccctcatttcattatttttcaattatgtttgaaaataggatttgcactgctttattttaggtggctgggagttttgattgcatattttgttatagttcatagttggaaatatttgcgtaaatggttttcaacaagcctgaaagtaatttcaagaatgtttcagttatagaggtaaaatttgcacacaaaacatcttaggcactttttaacattctcaatcatgggaattttaacttttgggatttgttgaaatcttttttattatccttcacaatttcaatgcttcttttagtcagaaatgattcagggttatttgaggggaaaaaaccccatagtgccttgattttaattcaggtgataactcaccatcttgaagtcattgtccggtttccgtagcagttttgaaaccttagtacctttttaacagcatgtgggtgtcagtgtcattattagtctcctaataagttcctctgaagactgctatcagtctcttggactggaggtacaaataatttagaaataaaagatgataacctaacactatcatagttattaatgtgatcctaaaattgtttcctaaatcagcatttttctttagtcatttaagaatttaccagaaatatttgctcaatatgatcttgatattcctacaaagaaaaaagaaggggtagggatttggctatgccttcactacaacattagaatattgtaactcacatgccttctaaacgtgaactaagatttcctttggcaatatcatattctaaaagtaataaattccaatacaagttacatacatttaaaaaacattttacagattttatggtactaatgaaatttacagtgatagaacaaaagaggattagtagaaaatacattattagaatataaaaaatgttattactgaggaaagggaggagaggacaagtgtaataaatcaaaattgacctcaaaagaaaatgtgtaacagagttgaggttgttaaaacagaaaaggttctgaataatgaagattaacctaatgcagaattgctaggtaaagaggtcaggggaatgctaagccagttcttaagacttctctgtcctctgctttgctgttatccttaaggcatatactttgtctttctgcagaaaattctacctggctacaattactttgaacattaatgttgaaaaagaaaacaaccaaagaaaattggtacttacccttctacaaaagaagtgtgactagatatcaatcagtaattaacatatcaaggagctcttctagctaaatgaccatccagtagagatttcccacattcccatgaatatcaagaatagttgtcagaatatgtatgtacctgagcatatgtacacagacaagggggatgttgtggaatatggcaatagcattgttcttctcccctttcaaattgcctttcttgaccttatgccattccatatatatctgagttgtgcctcatttatttattggcaatacctagtgatacggatttagctaacaaaagatatgaagaactattatattgaggcctgtcctctacataccacacttaaaagatggtgaactgtgagtactacttaggttgacagcaacaaagcataagacaagccccaggtaaacgtctaaactgtttactcacattgtcctactccagccccttcaattatttcccatctccacaaatagtcgggggaaaaaattaaaattttcctttatgattcttactgttcttcgcagctcatcttttcctgcttagaattaaccattgctaatttaaaggagcagctagctgcttttctgtcagtctgaagcgtagtagtggaagaggtagtaagcaccagctgcctctttgctgctttgttttcctcctgattctcttaaatttgggttgcaaagctatcccgccccccaccctgccccatgaaacttgagcattcaaatgaagattcagcagtgtctgttcttcatttctatagccaaagctgttagttaaaatcccaaatctatagcatttaaagataccaaatagaaacaccttccagcttt

SEQ ID NO: 791 - DNA, 1815 bp, Homo sapiens
taggattgacactggctgtcaaactcatccttcaaggtgattcctggcctgccctcctcctccaggcagcctgtcctcctcctccaggcagcctgtcctgaccctcagcagcctctcctggccttggcagagcccctcgtgtcctcccttgcagcacgcatgggaagaaaggccatcgtcctcgccattgctaacaccagccttgcgtttcctctttgccagcacctggtgacgttctgcctgggtgaggacgatggcgtgcataccgtggaggatgcctccaggaagttggccgtcatggatagccagggccgagtctgggcacaggagatgctgctgcgagtgtctcccgaccatgtcacgctgctcgacccggcctccaaggaggagctggagtcgtacccactgggcgccatcgtgcgctgtgacgcggtgatgccacccggcaggagccgctcgttgctgctgctcgtgtgccaggaacccgagcgcgcgcagcccgacgtgcacttcttccagggcctgcgcctcggggcggagctgatccgagaggacatccagggggctctgcacaattaccgctcgggccgcggggagcgcagggcggcggcgctcagggccacgcaggaggagttgcagcgcgaccgctcgcccgccgctgagaccccgcccctgcagcgccgcccgtcagtccgcgcagtgatcagcaccgtagagcggggcgcgggccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggacatcctgaaccacgtgttcgacgacgtagagagctttgtatcgaggctgcagaagtcggcggaggcggccagggtgctggagcaccgggaacgcggccgcaggagccggcgccgggcggctggggagggcttgctgacgctgcgggccaagccgccctcggaggccgagtacaccgacgtgctgcagaagatcaagtacgccttcagcctgctggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcaggtgacccaagcgacacagcagggccgaggctgggaagtccgggggcgcggccggtccgcctggccccgcctgacccgactgtcttacttcctacagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggccctccaggacaaagagaaagtgtcagagctggaggcagtgatggagaagcaaaagaagaaggtggaaggcgaggtggaaatggaggtcatttga

SEQ ID NO: 792 - DNA, 4122 bp, Homo sapiens
aggagaagtcgggaaggtggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggagctacgccttccacaaatccatttgttgctgctgctggtccttctgtggcatcttctacaaacccatttcagaccaatgccagaggagcaacagcggcaacctttggcactgcatccatgagcatgcccacaggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatga

SEQ ID NO: 793 - DNA, 2552 bp, Homo sapiens
gaaggagggacggccggtcccgtcagtcaggcagcgggagccgccgggagcggatggcggcggccgtagcggctccactcgccgccgggggtgaggaggcggcagccacgacctccgtgcccgggtctccaggtctgccggggagacgcagtgcagagcgggccctagaggaggccgtggccaccgggaccctgaacctgtctaaccggcgcttgaagcacttcccccggggcgcggcccgtagctacgacctgtcagacatcacccaggctgacctgtcccggaaccggtttcccgaggtgcccgaggcggcgtgccagctggtgtccctggagggcctgagcctctaccacaattgcctgagatgcctgaacccagccttggggaatctcacagccctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctgccctgcagaggatctatttccgggacatcggtacgatggtgggctggactcaggcttccacagcgttgatagtggcagcaagaggtggtctggaaatgagtcaacagatgaattttcagagctgtcattccggatctcagagctggcccgggagccccggggacccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtg

SEQ ID NO: 794 - DNA, 691 bp, Homo sapiens
ccgcctcagactcagagctgcgctcctcgacctcaacgccaggcggttactttgctgctcctcccgctcgctatgtcaacgtccactagctgcccgattcccgggggccgggaccagctgcccgactgctacagcaccacgccggggggcacgctatacgccactacccccggaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccgatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaatg

SEQ ID NO: 795 - DNA, 3708 bp, Homo sapiens
atgcctatggagtcagcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagcggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaactcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaacctcctcgtgttttttgtttttttggtggttttttttttttttttaggtgttagtgctacagcgtttgaaggagccagctgtagtctctttgatatgttcagattttccagatagagatttaagtctaaaaatttattaagtgaattctaaactatttcacacaagagtccattagcatctttaattttatttagtattcatgaattaatttattggcatcttatttggaggtaataggccacaactctttaacaaataagttc

SEQ ID NO: 796 - DNA, 1521 bp, Homo sapiens
cgggtccctcaaggccggaaagaaagtcgggcttctctagcccctggaggactcgactcactggtgcgcgatttaggtccggaggaggcgttgtgaggtgagctttttcagaagcgcgatcccaggacacgtcgggaagcaagcatccccagagctgcttggaaagaggaccaaagacgtctaaaaagtcatttggaaatatctctaaatatttgttaccatgtataagctgctaaagagaaattgggcccaacaaaactaattgaataattgaggcagatttgtgtgtatcatcaaattctatccagaagttgaagaatctgaatttaaagattgtgtgcatttaataagaggatgacctttcagtttaatttcactatagaagaccatctggaaaatgaattaacacccattagagatggagctttgaccctggattcctcaaaagagctgtcagtctcagaaagtcaaaaaggagaagagagggacagaaaatgttctgcagaacaatttgacttgcctcaggatcacttgtgggaacataagtcaatggaaaatgcagctccctctcaagacacagacagtccactcagtgcagccagcagttcaaggaacttggagccacatggaaaacagccctccttgagagctgccaaagagcatgctatgcctaaagatttaaagaagatgttagaaaataaagtcatagaaacattaccaggtttccagcatgttaagttatcagtagtgaaaaccatcttgttgaaagagaacttccctggagaaaacatagtttcaaaaagcttttcttctcactctgatctgattacaggtgtttatgagggaggcttaaaaatctgggaatgtacctttgacctcctggcttatttcacaaaggccaaagtgaaatttgctgggaaaaaagtcttggatcttggttgtggatcaggtttactaggtataactgcattcaagggagggtccaaagaaattcactttcaagattataacagtatggtgattgatgaagtaaccttacctaatgtagtagctaactccactttggaagatgaagaaaatgatgtaaatgagccagatgtgaaaagatgcaggaaaccaaaagtaacacaactatataaatgccgatttttttctggtgagtggtctgagttttgtaagcttgtactaagtagtgaaaaactttttgtaaaatatgatctcattctcacctcagaaaccatttacaacccagattattatagtaatttgcaccagactttccttagactgttaagtaaaaatggacgtgtacttttggccagcaaagcacattattttggtgtaggtggaggtgttcatctctttcagaagtttgtagaagaaagagatgtttttaagaccagaatactcaaaataattgatgaaggattgaagaggttcataattgaaataacttttaagtttcctggttaattaacattcactgagtatccaaaatgaaataaacagaaggaccaaaaa

SEQ ID NO: 797 - DNA, 920 bp, Homo sapiens
ggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctatgaa

SEQ ID NO: 798 - DNA, 2112 bp, Homo sapiens
ggcagcggcagcggcggcgggacgcggaggctcccccgggattcggcctcagcagcgaggcggcggcggcggctgcggaggcgcaggcagcaactgaggcagcggcaggctcaggtgcagccgctgctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctgattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcact

SEQ ID NO: 799 - DNA, 1613 bp, Homo sapiens
ctgcctgtcagatgcctcattcccacctgtgatgctcagagagaaaccatgagccctgaaaaacaccatattgttttgtgatgtcacctctggaatgttctgagtgttttggtgaccaacttctgcataggacctatacctggcaactcacattgcactcaaggccaaattatacaagaaaaagagataccagatctgaaagcctagaaattccaatcagtgtggttctacctcagaggggcacagccgaacccttcccgaggctccacaacttgtacagcacccctcgctgcgcgcagcaggccgccctgccccggctgagccgcaggatggcgagccagcactcctatccactgaaccgcttctcctccgtgcctttagaccccatggagcgccccatgtcccaggccgacctggagctggactacaacccgccgcgggtgcagctcagcgacgagatgttcgtgttccaggacgggcgctgggtaaatgagaactgccgcctgcagtctccctacttctccccatccgcctccttccaccacaagctgcaccacaagaggctggccaaggagtgcatgctgcaggaggagaacaagtctctgcgggaggagaacaaggccctgcgcgaggagaaccggatgctcagcaaggagaacaagatcctacaggtcttctgggaggagcacaaggcctcgctgggccgagaggagagccgggccccctcgccactgctgcacaaagacagcgcgtccctggaggtggtgaagaaggaccacgtcgccctgcaggtgccccgtggcaaggaggacagcaccctgcagctcctccgggaggagaatcgcgcgctgcagcagctgctggagcagaaacaggcctactgggcgcaggcagaggacacggccgcccctgccgaggaaagcaagcccgccccctcaccccacgaggagccctgcagccccgggctgctgcaggaccagggctccggcctctcctcccgcttcgaggagcccaaagggcctccggcccggcaggaggactccaaggagctgcgcgccctgcggaagatggtcagcaacatgtccgggccctccggggaggaggaggccaaggtgggcccgggcctgcccgacggctgccagcccctgcagctgctgagagagatgaggcaggcgctgcaggccctgctcaaggagaaccggctcctgcaggaggagaacaggaccctgcaggtgctacgggcagagcacaggggcttccaggaggagaacaaggccctgtgggagaacaacaagctgaagctgcagcagaagctggtcattgacaccgtgaccgaggtcaccgcgcgcatggaaatgctcatcgaggagctctacgccttcatgccggccaggagccaggaccccaagaagcctagcagggtctgaggcctcggccttgcaccgggacgccgagtttgggacaccgaacactgggcaaaagagaatcccctgccttcctttgtcgtcctcgccttccccagccagttcgtacctattgaaaagcagcgttagcagccttcctaaactcagagttttaataaaggtgtgaggaggctggggccagttgacacc

SEQ ID NO: 800 - DNA, 1520 bp, Homo sapiens
gaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatagtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcatcgtattgtgtatattcacctaatgcccattgtgtattgatattgcattcttgaattttgaacactgaatatctttttgaaagattatacttctttacctctttgtgctttagaaattattttccttcaagtgttcaagtctaatgaagaatgaagataacattttatcacttctgtccttaaaggtttcagacatggtgaaactgaataaagcatgtcatttgctcctagatagattcattctatctagttgtggggatggagaaatctttaatggtatattttcggttattgccttatttttgatacagtattctgtcagtaatttattagacctggcagctttgggtgagcttagatttttcaccttcagtgttacattgtgtttgcttttaaaaactgcttttgaatggagttgtaaatacaatttttctatgaagatgt

SEQ ID NO: 801 - DNA, 6351 bp, Homo sapiens
aaaacggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggttggtgaaacagagaccaggctggagtgtttgctaaacaataataagaactctgatttctgtgctcccctgacctcctttgactggaatgaggtggatccttatcttttaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtggtgattctagatgtccgggttccctgcacacctgtcgccaggttaaacaaccatcgagcatgtgtcaatggcattgcttgggccccacattcatcctgccacatctgcactgcagcggatgaccaccaggctctcatctgggacatccagcaaatgccccgagccattgaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaagtaagaagaaacatgtttccagtggccagtatgtctttcattgctttgcacccactgttaccagaagctgctctaggagttcctggccagtcaccccatcgccctctgtggcagactcagtgctgtgtggcgcctcctcagcccagggctgagttttaagattttctctcctttcctcttctcctttggttcctcaattaaaaaatgtgtgtatatttgtttgtcaggcgttgtgttgaggagcagttcacgcactggctgtgtctattcctctgcccaggtgtctctgtttgctgcccaaggcagcagttcatgtctcgtccatgtccatgttcgtgttagcacttacgtgggaacaaataccaatttgtcttttctcctagtatcagtgtgtttaacaaattttaactttgtatatttgttatctatcaggctaatttttttatgaaaagaattttactctcctgcttcatttctttgtcttatagtcctccctctttgcaccttcttctcttccctcagtgcctggagctggtactgggcccctggccccatgagcagtttgccttcttgagtcactgcctgtgtagtacatacctgaccgggagtccaaaccaccttggtgctctgaagtccactgactcatcacacctttcttagcctggctcctctcaagggcattctgggcttgtaaacagacataggaagcctctgtttaccctgaagcaccactgtccagcccattggttcccactggcagcatggtagagctgagagaaacaggctctcagggtacctgacttgaggggaatcgtttcatgaagctgaacttcaagcatatttccagtacattctttcagagtctgtttttccatccaaatataagccccaggccattccacttagtgtcttttcaatgataggcaagaatgatatctgagttgaacttcggtgcttctgttgtttgagtttactgtgcctggtggtatattgggcattctttggattgagtgttctgaggtgagagagtcttcccgaggcatcctgtctgtgcttccaaccctgaacaagaccttacatgagagatggactgatggactgcggcaatcctgggctgtcaagtggatagatagttaaaaagcattatactgtgggtaatgaaaagggaggaaaaaaaaagaaggaaaaggaattatagacccccagggtcagccagttaagagctctacccacacctgtcaacccctctctcccccagtttaggttctgagcagtattggacttgtagcctgcagttgtcttttgacttgcaggccgcaggtgtctttctgttatgtgaatgagttccatggaggggcatatgtgtgattccaccgttagatgagcccttggggcaggcagtttgggatgtgctcttgggggaaagttggctgtttccttgcgctctgctcctacccgaaggtttttaagtccctctgaattgctcatctgagattagtagagtagcaggcctgaaggatgatggttttgtcctctttggttctcacctgcttgagaagtaaaacagtaactttgttcttctgggcccttaagcttttttggttaagtcttccttttcagaagtagatgtcattatatgccaaaagtctagctctttgctttaccatacagggacctgtcccaaagaaaaaggctctttttttagccagcatatttccccttctacccttttactttgttgttctgattttaggactctggctggccatgtgcttgtggttgcctctcctgcatttgccactggatttgcactgcatcgtttggagatacaaagcgagcagttcttggtcagaaccctcctctgcttttcattgtgtttgataatggttactgggtccttctctcaagggtagcaaggccaagctgatggctgcttgtttaggaggccatcagttccttcctgtggagaagggtctgaaatggaagtcagtggtagaaggggctggtctgctgggcagggcttacatccactgagttctaagattcctttcctgatctgcacctacgcctggtctgtatggtggaatttgtcagctggaactcagaaacaacaacttgaaaaaaaaataataattagaacatatttgcataagatagctatttactctggaaaccaacaacttttgagatttcccttgccctgtggacgcccagctcctgtcatccttccttaggtcctgcagtacagtcttcccctgaatgccaccggggacccagggggactccacccccctaagcaagcacacacatactcacagttgatgagttgctggtctttgagtcccagctctcttaccctccctttactccaccagcccgacgacccatgactgaggaggggatttctacagtctcaggatttagaaagtctgtaagccatccatgctccagaaagcaccgatctgttgtagttgcaaaaacaactctgtaatttgttgaggttctcaaactgacagccagcgagactgggtgggaggccctggatctgttctccctgactgcgggaggagcagccactaggactttagcaggaagcccacatggaggctccgccaggctgtggcccagctggtgatggcccttttgctcctggcagcctgaggcacagctgcctgtattgtcctcatctgttctgactgaaggatggaggtgctgaataaattaggcctcaggcctctaccaccagagagctggagaatgggtccacgtcattcaaggacctgaattttttatgctcaggagcattggaatcctcttcttccagggaggaattagcctgcaaggttaggacttgaagagggaaggtatttaataactgggcgaggatgggtgtggtggctcacacctgtaatcccagcattttgggaggctgaggtggccagatcccaaggtcagaagatcgagaccatcctggctaacatggtgaaaccccatctctactaaaaatacaaaaaaaaattagccgggggtggtggcgggtacctgtagtcctagctacttgggaggctgaggcaggagaatggcgtgaacctgggaggtggagcttgcagtgagccaagatcgtgccactgcactccagcctgggcgacagagcaagactccgtctcaaaaaataaaaaaaaaaaaaaaataggtgaaaattccttataaatccaggattggctctgagagaactggctaagattcaggaagaaacaaaaaattcagaatcctacaaggttttgatgacaattagggccaaaattttaggaggagatgtaggatgcaggagaaaattaaagtgttttctttatatcagaggaggaaatagtagaggtcagtgaaggtctggggtagggaaacattcagactgtccattgcatggctgtggagtgagactgcccttagcctgggtcagccttcctgggccataaattgggcatccgtgatgctaggtaactgtgggaacaaaatgacagcttagagcagccatgggtgatgtttggtggtaaaaaacctacaggcgtttggggtcccatgattgttccagaccatgactcttcctggttgtgggtttgttacagagcaggagaagcagaggttatgacagttatgcagactttccccctcctttttctcttttctcttccccttgcttttccactgtttcttcctgctgccacctgggccttgaattcctgggctgtgaagacatgtagcagctgcagggtttaccacacgtgggagggcagcccagtactgtccctctgccttccccactttgagaatatggcagcccctttcattcctggcttggggtaggggagaccattgaagtagaagcctcaaagcagacttttccctttactgtgtgtactccaggacgaagaaggaagatcatgcttgatacttagattggttttcccagggaagagggcggagcagagcaaagtcactgtgaaccctgggccaggccctggctgggccagctcctgagagcgtctcgtgttgcagacccttgcccacttcacccacctgcaccttctccccctctcacagtgtcactgctgctaatggtcaaagtcaaatgtgtggccacatgggatgggccaggtcctctcaggctactttctggatgtcatttttaaaatatggaaacatgcaggtgccttcccaaagaggcttggactggtatatccaacgagaaacaaataagctaaagaaagtttaaactcaagaagaaagatgttgacagtctatgtaacagctggaaagtttataggcacccacctttgggacaacccagtgattatgaacatgtgatatctactatttaaaagaaatgttctcaccttgggttgattgtggtataccatgtgttatgaaaattgttgagctgaagctttgaatcgatttagttgagtctgactcacttgctttggttcctgtgtattttactacccctcttgtcagtgaccttccttccccaccccacccagagtgaatttgtagcatgattgtataaacctctatgtagaaaatggagatttcttgctctgaaatgttaagctctaactgatccatttctgtgtcctttagcctagtatgtctgaacttccattcttgttatatatttaaactttccctctatattataggttttgtggcatccacggtcaggtgtagaggaagctgccccttgcagaactgtactgtaatatttttcttttataaatattttcacaggactgattgtacacagggcttgtaataaaattttaacactgtgctgtgaaacaactatggggaatctccattgaaggctacttcatgggcacctgaaagtggagtgttatagctatgactttctatttcttgtttcctaagtaaattaaacctaattttcaccctttcattctgtttcagcctcctgtataagaagtaccgtattttctgcccatcatactttgtaataaaacttgaacatgtatagattgactg

SEQ ID NO: 802 - DNA, 2717 bp, Homo sapiens
gggcaatcggcgcaggcccttcgtcgtgccccgcctcgtctgccccgccagcgcgtcgagggaggggccagcgacacatggcctagtaactgtccggccgcggcgctggcttaagccatggctgagggtagccggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggttaatacactgttaaatgtgaaattaagtgagacagaaaatggcaagcatgtctctatattggatctacctggcaacattcttattatccctcaagctacccttggaggaagactaaaaggaagaaacatgcaatatcactctaactctggaaaagaagaagggtttgaactttactctcaatttgtgactctatgtgaaaaagaagtagctgctaatagcaagtgtgctgaagctagggttgtagtggaacatggcacttatgggaacaggcaggtgttaaagctggacaccaacggaccattcacacacttaattgagttttgaaaatgaaaaactagtttctatagctgttttctggtatgaaatgatctaaagtataattagattttcttccccttaatcttgaatatactaatcttcagcatttttagacaggaaaatcttgggtttcatatataactctgcacctgctaattggatgactttgccaagtcacctaaactctggatctcagtcaccttttgtcctacattcctctacccttctacttgaaaatttgaaatatgctgtctattcacttcatagtcattaaggaaatgttcttaattgtttttttgtttttgttttttttttgagatggagtcttgctctgtcgccagactggagtgcagtggcgcaatctcggctcactgcaacctccacctcctggattcaagcgattctcctgcctcagcctcccaagtagctgggattacaggcgcatgccaccatgcccagctaatttttttgtatttttagtagagatggggtttcaccgtgctggccaggatggtctcgatctcctgacctcgtgatccgcccacctcggcctcccaaagtgctgggactacaggcatgagccaccgtgcccggcctcttagttgttttttaaaaattatgtacattttaagtattttgcaatgaagaaattcatgcaaacaagaaaaacacatttcttataccatcaaatttgtgtagcatgtaataaaaataactatttgtattaaaattaggtaaacttcagcacaacccaattataactttgttaattttgtttactatttcagttttctgtatttccatatgtaagtcaccatttcttttaataatatgcatgaaaatgtaatatagggccaaatgtggtggctcatgcctataatcccagcactttgggaggccgaggtgggaggatcacttgagcccaggagtttgcgaccagcctgggcagaatagcaagacccagtctctaacatatacatatacatatagatatatatgtaatatagaagggttattgtgtgttatattactttccagggacattcaaatgttttacattactttaagaatctttacttgatataagaacaaagtataagggtttaaaagttgtttttattaaacatactatataaatgggttaatggtctatttttcagtttttaccaaaatcatgtgtctcactttttgtcttcgctttttaaagaactggttcatgaaattagtgttagttcataaattgtttaagaagttccttttccattgaattagattgctgtaaaagggagaaaaagggaagcttcccataagaatagtttgaaaacaaattgacttgttcatttccatattatctgcttgatgatatggagccagtgtcaatttttctgttagtgaatgttttggactagatgttcccgtccccaaaatttatatgttgaagcccttattaatgtgatggtatctggagatggggctcctccaaccatcccatcctggaacatataagccagaaagaaagtagtctccagaaacagaccatgctgacaccttgagtttgaacttctaatcaccagaactgtgaggaaataaatttctggtgtttaaaccacccagtcctatggtattttgttagggcagtctgagctacgacagtgatataagatagacagctagtaaggtaaacttttcaaaggcaagagaggaagatatacaagaaattgaaagaataattaagtcagtaagaggtaatattcagttttggcaaactcctctgacttgagttgaaaatactttttttttttaagagtaaaaaccaaataactaattctaattggcaaaaaaaggtaaataaataaacatcctaagtagctgctgaaatttccgttgtgtcttatagtttctttaggtctgtgttcctaagatgcttaaaatttttatcatgaaaaatcctattttctctatacccttcctgtactgttctattttggaaccagagaatcaataactggcttggtaatgagctcattgtccttaacttttgctttattgattcacaatacacttactgaaatgtaataaactattcataaacttgcaaa

SEQ ID NO: 803 - DNA, 4258 bp, Homo sapiens
atggaaggggcgctgactgcccgggacaaggtcggggttcaggattttgtgctattggacgcgtacaccagcgaatctgcctttgtcgacaacctccgcaagcgtttcagcgagaacctcatatacacatatattggcaccctccttgtgtctgtgaatccataccaggagctcggaatctacactgtgagccagatggaactttatcaaggggtcaatttctttgaactgccaccacatgtctacgctatagccgacaacgcttaccgaatgatgtgtgctgaactaaataaccatttcatcctcatttctggagagagtggggcagggaaaacagaggcctccaagaaaattctcgagtattttgcagtgacctgcccaatgacccagtcactacaaatagcccgtgacagactgctgttctccaacccagtgctggaggcttttggaaatgccagaacgctccggaatgacaactccagcagatttgggaaatacatggatatacaatttgattttcagggcattcccgtaggtgggcatatcatcagttacttgatagagaagtcccgagttgtctaccaaaacgaaggcgagcggaatttccacatcttctaccagctgctggcaggtggcgaagaggagcgcctgtcttacctgggactcgagcgagacccccagctgtataaatacctctcacagggtcattgtgccaaagagtcatccattagtgacaagaatgactggaaaactgtttccaacgccttttctgtcattgattttactgaagctgacctcgagaatctctttggaattattgccagtgtcttacacctggggaacattggttttgaagaagacgaccaaggctgtgccactatcccagacacccatgagatcaagtggatagccaagctcctgggggtccacccatcagtccttctggaagctctcacccacagaaaaattgaagccaaaactgaggaggtgatctgcccgttgacactagaactctctgtctacgctagagatgcaatggcaaaggctgtttatggacgaacgtttacttggctggtcaacaaaatcaattcctccttagttaacaaggatttcaccaggaaaactgtaattggattactggacatctatgggtttgaagtctttgacaagaatggttttgaacagttctgtataaattactgcaatgagaaactccagcaactgttaattgagaggactctaaaagcagaacaggcagaatatgaaatggaaggcatagagtgggagccaattaaatatttcaacaacaagatcatctgtgatttggtagaagagagacataaaggaatcatatctattctggatgaagaatgcattcggcctggtcctgctacagacttgagtttcctggagaaattggaagagaaagtgggcaaacatgcacacttcgaaacccgtaagctggctggtccaaagggccgaaagaggattggctggatggagttccgactcctccactatgcaggagaggtcacatactgcaccaagggattcttggaaaaaaacaatgatcttctttacagacatctgaaagaagtgctgtgcaagtccaagaacattatcctgagggaatgcttcctgctggccgagttagaaaaccggaggaggcccccaacagtggggactcagtttaaaaacagtctgagcagccttctagaaaccctcatctctaaggagccctcctacatccgttgcatcaagcccaacgacaggaaagaacccagcaaatttgatgacttcctcataaggcatcagatcaaatacctggggctgatggagcacctgcgggtgagacgggctggttttgcataccgaaggaaatacgagcatttcttgcaaaggtacaagtccttatgcccagacacctggccgcactggcacgggcctccagcagagggcgtggaacggctgatcaagtacatcggctacaaacccgaggaatacaagttaggcaaaaccaaaatattcattcgtttccccagaactctgtttgctaccgaagatgcctttgaatttagtaaacatcaactagttgcaagaatccaagccacttacaaacgctgcctaggaaggagagaatacgtgaaaaaaagacaagcagccatcaaactggaagcccactggcgtggggccctggctcggaaggcaatccaaaggagaaagtgggccgtgcggattatcagaaagttcattaaaggattcatcagtcgcaacaaacccctctgtcctgacaacgaggaatttatcgtgtttgtgcggaagaattacatcttgaatctccggtatcaccttccaaagactgtcctggacaagagctggctgaggcctcctggcatcttggaaaatgcatcagatctgctcaggaaaatgtgcgtgaggaacctggtgcagaagtactgccgcgggatcacagctgagcggaaagcaatgatgcagcaaaaggtagttacaagtgaaatcttcaggggaaggaaagacggctacacagaaagtttaaatcaaccctttgtcaacagtcggatagatgaaggagacattaatccgaaagtgcttcagctaattagccatgagaaaatccagtatggtgtcccggtcattaaatatgacagaaaaggcttcaaagcacggcagcggcaactcattcttactcagaaagcagcttacgtggtggaacttgccaaaatcaagcagaaaatagagtactcagctctcaaaggtgtctccactagcaatctgagtgatggaatcttagtcattcatgtttcaccagaggacagcaagcaaaagggggatgccgttttgcagtgtggacacgtgtttgaagcagttactaaactcgtcatgctggttaagaaggagaacattgtcaatgttgttcaaggaagtttacagttttttattagtccgggaaaagaaggcacaatagttttcgacactggactggaagaacaagtctataaaaataaaaatggacaattaacagtggtgtcagtccggaggaagtcctgatagaggatgacgtctgacctctaccatcgccatttttgctccaactgaggaaactacaggggaagtggggattggatccagttagctacctcttcaaggtaccaggcccgcagcactaacagatcacatctgaagaaactgaggggcgttaggccaaagcctaatcccagctcctcagctgccccatggcaccttatttaaaatgtcaccttctggaagcagaccccaggtcacccgaaggcgcaattctaaacaccctcgacaggatctatgttcagtgcgcagtccaacgtgtcattagagggtgggcaagattctctacctctgtcaagctgccctgagacatgatgaaatactgtgtacagcaagttctcaaataacatttcgttatatgttgataagacatctgattcctgggcagggccactgtctgggtggagtctgtatgttctccccatgtctctgggtttcttctgggtgctctggtttcctcccacgtccccaaggtgtgtgtgtcaggtgcactggcgtgtctatgcggtcccagtctgagtgagtgtgggtgcgtgagccccgtgagaggaggacatcctgtccagggtgggtcccgccttctgccctgagctgctgggattgggctctggccatctgcaaccctgaacgtgcaggttggagaacgaatgaatacaaattttattgtaaaataaaaatgtatataaagcatatgagcacacaaatggacaataaatgccacagcgcaaaagcgtgtagcgagcctgccacgcttgtgactggggaggggctccgtataatctcacctttgcaagcgtttatttactgatgtatgcggccaccactgtgaccaccatcacttaccgattcaccaaaacttaggtaatatggtcttatttttgatttaattaaatatacgtgtagctcatgtatttcacagtttaatatgagaagtgctttggtctttatttagaaattgggtgatgtttttgtgcccagcaacatgctgtaggaatttaactcttgtttacatccattagcctcatggttttgcttcaagtctcagcttccaagaacctatcgatgacttactgtgcatggtctgagactaagtaaaggaaatttcctaaagctgtgaaatttgaattttgctttaaataaatggaactcacatgtg

SEQ ID NO: 804 - DNA, 1447 bp, Homo sapiens
gaggtgggggcgggggccttaccccaccctggcaccggcaggcgcgggcggatggggggatgtcgcctagagccccccggccggcccacaaactcccgtcccccttccggctctgcctggacgtccctgcgggccccgggggaaagcacccaacttctcccgcctcggcttctagcagaaacgtgacggggctggactttgatcgccgagggctctctgctcttcagagtctgcttggaacgggataagagggatggtgccatccagggaagctctgctgggaccaggcacaactgccattaggtgccccaagaaattacagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgtagcccggtctcaagggaaaggcatcttcctcttccgtaggctgaaggacatcgtggactggaggaaggacacaagaagctctgacgaccagaaagatgatattcccgtggagaactatgtggctcagcgttacattgaaaatccttacctgataggaggccgcaagtttgacctgcgtgtctatgtgctggtgatgtcgtacatcccgctgcgggcctggctctaccgggatggctttgcccgattctccaacacccgcttcacactgaacagcattgatgaccagtatgttcacctcaccaacgtggctgtgcaaaaaacatctcccgactaccacccaaagaagggctgcaagtggacgctgcagcgcttccggcagtacctggcgtccaaacacgggcccgaggcagtggagacactcttcagggacatcgacaacatctttgtcaaaagcctgcagagtgtgcagaaggtgatcatcagtgacaagcactgcttcgagctgtacggctatgacatcctcatcgaccaggacctcaagccgtggctcctggaggtcaatgcgtccccatcactgacagccagcagccaggaagactatgagctcaagacctgcctcctggaagacaccctgcatgttgtggacatggaagcgagaagtttgagggctgattctccttgctggtaa

SEQ ID NO: 805 - DNA, 2711 bp, Homo sapiens
agtcggagcgaagcggctggcggagcagaacggattgcagggtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattactccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcagggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcagatgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagaggcaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccattgtttcctcgcctgcgatgctccttgtacatcctcaccctcctctcccgcctctgccttctgctgggtcaaaggtggccttttctctccagccttgaattgttccctgttggcttcccaagggcccatctgctggtacagtccacacttccacagccaagacccgagagggctttcactgccccaagcctctctcctgtgaccctgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgcaagg

SEQ ID NO: 806 - DNA, 1562 bp, Homo sapiens
cgagcaggccgtttctgccgcgtccaccacaacctctgctgtatcagagggggccttcgccgccgccgcccccaccaccgcccctgccgccatcgccacctccgccgctgccgccttggggccctcctccttcaccgcccccttcaccacctctacacgttctaggccttctgtcctggagaagaagctatagtcgttctcccttgtgggcccggggcgcagccatggcggacggcggcggcggcgggggaactggcgcggtgggcggcggcggaactagccaggcctctgccggggcagcgactggcgctactggggccagcgggggcggtggccccatcaacccggcctcgctgcctcccggcgacccgcagctcatcgctctcatcgtggagcagctcaagagccggggcctttttgacagcttccgccgggactgcctggccgacgtggacaccaagccagcttaccaaaacctgaggcagaaagtggataattttgtgtcaacacatctggacaagcaggaatggaatcctacgatgaacaaaaaccagttgcgaaatggtctgaggcagagtgtggttcagtcagggatgttggaagctggagtagacaggattatttctcaggtggtggatccaaaacttaaccacatcttcaggccacaaatagaacgagcaattcatgagttcctggcggcccagaaaaaagcagctgtgccagcaccccctccagagcccgaaggccaggaccctccagctccatctcaggacacttcctaagaatacgccagacaccttttgaaagctaatttttggtgaagaaatggattcggttacataagagtgcaacttcagactgaagataggccaaggtcgtcactgatctcaagatttcaaccttgaccatgggcagtgaccagattgaaaggggagcaagttcggcagtgggagagttgaccgtgtcaccccctgcattgtgctgccatttggccagcctgtccaagggcatgacaccaagtagacactacagagagagaaacactacagcaacccagggttgtcctgaaacagacttttatacttgaacatggagactgcacatggactttagggtttgtgctgtgggataaacggaagctacagtgagaacatagccagtcccaaagacaatttcaaagaaaaatgacagtaaagattagctgggagtagtctttgacagtgcttatttgatactgtctctcagagtttgcaaaccagattgtacaagtcattagcgtcagatagctttaaagttgtgaccttcttgtacatgaatcttctagccagtttcctttcctttgtaacgaaacatgaaatcctagaatgtatgagaagttcagacattaggcataaggaaactcgtttgcaggctctctgtccagggctgcttcctgtcctggaggggccagtgagtcttaggtatgtttattttattctcacatttgtgtttttttagaaaagtgaatggtcaataaatggcttatctttcataataaaattatttgatacttttactccgaa

SEQ ID NO: 807 - DNA, 10242 bp, Homo sapiens
ccgagccgggagccgagcgcgctgggcgcggccgtcccgctgccgccgccaagcccggagtgcgccagcggccatggttcccgcggcggcgccgggcgcctgagccccgggacgcaagcgctggaggcgggctgccggctgtgcgggcgctccggagagaccgacagaaggtgagcactgtgggctatgggatggatgaggtggagcaggaccagcatgaggcccgactcaaggagctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactggacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctcaatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagcagtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggggctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaactctgcaagaacactaaggcagacgcaatggtgaaggacttgtatgttgaaaatgcccagttgttgaaagctctggaagtgactgaacagcgacagaaaacagcagagaagaaaaattacctcctggaggagaagattgccagcctcagtaatatagttaggaatctgacaccagcgccattgacttctacacctcctttgaggtcatagccaaaccaaagggtacactcatatttgtgcactttactgaaatagatgaacatttcagtaggttctcaacttaaaattaagcctaacctaaaactgccagcaacacaactggagtttccatttatcataattagtttttctaaatagacccttatgggagtttgaaaataaatactcacatatttcactacttaaattattcccaagatttgaatttattttaaaattttaatagccaccaagaatgtggacatatgaaaattcaagaacctaaaaaataccagttttgaatgagtttttgtggttttggttttttttttaattattacaaatctatgtgtaaaatctagatatttgaagtttgagatctgatgagaatggttgttataaactttattttaaaaccaaatttaggtgttcttacatatttaaatactggaaagtcattataatagttttggttctttgaattggtagacaattagtagagtataattggttaggaggcagggcttattaagtggttattaaccgctgacatcagacaaacccaaatctgtagaattctaaccttctaacacctgtgacagtattaccactcttcttgtattatagatttagaactgatttactcaattgcactcttaactaatgttaaaagcttacttgctttaaacagccttttcttctttctcttaaaagtttcatttggggagctggtcttctaagaaacggataaagccacataattaaagcagttgaactatagggaaagcactgaacaaaccactttggagtaaatagctactcttagaaaagagggataagcagaccatgtaggttttctgtctctcaaatcttagagttcataaatttacttgaggttgcctcaagaactcagggaacaatactgtaaactgtcttcctgaactactgtagggcctctctaagaatttgaaatgtataaaccatgtgacctcatttatttgtcttatatatttacagccatactagaatttttatttctacgtttttagtaaatttaatattctgggggaaaaaaggccttgattttagggttaaaaacctgacttatagaagagtttatttaatataggtcaaaattttctgtgtttcttattccttctatacctcaaatctgattctaagaatttcttactgtgataatcattggcatgccacctgaggtcaaggagtgccaaataggactttccactcatgctcaagatcaaaactttatagaacagtcaacattttagattcggtaaccttttttttcttccaattataatctctgctagccacttccgccagcagttggtggaagacttactaggtgcagggcactttccaagttcatcacaacaacctgcttgttttcatgagacaataatccgaaaagttcgctttgatatattcctggagggccaagcccatctatttacaaaaggtgaacagcaaaatcaagcactgctttatgggcaggaacacaagagaaagcaaactgcccaagaagtcatcatgtcagaaactcaatctcaacaaaataatttccatcagggaacttcagggtttcttgggggcttatgagtctcaccggtcaacccaggaggcctcactacaagagccttgacaaggcactgttttttgtgggactgggagttcacactgatgaagcaaacctttgaatttttgcacagctcttgtcagaaagccctgagttccccctggataaagagttaattttaatccttccctataattatacttcaaaatatttgacatctgctattatgccttctttagatctttcttctgtggtgcagacatttctagtaagtgtttgactacttgtatggcattagctttcacagaaaattgtttcacttaaaactgtggattggcctaggctaaggacaaaaataaactaagtacctgtagtgtatttatgtgatatgtgtcaagttactcaaagttattgctgttggaactgaacaataatatttcccagatagctggccttagcatgtgatcacggttgttgtatttttaatttttgtcttttacagtatgagaggtgtaggttaatttgtttatttcctataaatttgtatttatgtgtatataaaatgtacaatgaatgtaaatatgactttctggaaagtttagactacatttagaatctctattcaaaatcaaaatgctgctcaaatgaatttaaccaacatctaggtgcttaatttctcattttatcccacttatgagattgggaaaaagatcaatatgagaaataccatacagataccttaaatgtatgcatttgtgcaacaatttttgagaaggtgagtggcaatttataatttagttggcaatttataatagaacttatagcttttaaaagaccttttaaagacattaaatgtaaacttaaaaatgtttagatcttgtttcaaactttacaatagcattcttcaaaatattaagttatatattttataggcatttagttgcttattaaaagcactgattttcaaactttttgatttaagaacaattatttaagatcgtctcagaagatgggatcttcgtttcaagaaaagggaatcaagtttgcctttgagataatacgttacactaagaaaaggaaaatgtggatagtaaaacccacctctctcatcctattgtactctcttctgctttttagaagcctgcacttaagcttagatttgtgaagggagagtagaaggggagaagtagaaccacagtgttttatttatttttctaaaactcttactaaatccagattttttaaactgttttaaatgtgaattcttcccagaaatttcaatgcattgcatatttagccttcggcatatttttcatgaatagatcatgaagtcataggcttccaaggcataggaagagatcttgcaggtctagtattttaataatgcactattacccagggcagatattatgagaaactgtttcttctctaagggtttatggcagactttgcttttttaacatgtgagaaatgaattttttattttgtgatttatgtgatttcttttgctgagtgaaggaaaggagaaattgttgctattgtcagcatcttaaaggtatttccagtcaaggcaaggctaagtgctttgtgatagtattaagcaagtcatgttttgaatggattacctgtagtgactcattggaatgatataattatacaagtaatgccaaaaaccaagtcaaagcctaattaaccaaagcactcatttaaaaatcatcatgtttggacctatctggacctctcagcactgtaaaatagttttggttttgtggcatatgaatagctgtttaacaaatcaaagttagctttttgcttctcagcttttttgggcaatacaagttaagttcttaatggggagacattatcatggcatgacttaagggaacattggtttgtgaaggaaaaacagattatctaaagccatctctatgtttctgttcagataaagattaatgagttctgtgtttatatcagctttgtatatttcatcttagccattctatcctagaaagattttaatgtgagcttaagatgtaaataaataattttgcaaacatgccttttgttttctatataccctgaccttttaataaagtttcagtgtatttatca

SEQ ID NO: 808 - DNA, 3662 bp, Homo sapiens
gccggggtgcggagggagtccctgaaacttctcccaacagccccagggccaatcttccctcagcccactcccctcttcgccagctcccaggtccccactcctgtaccgggggtggggtggggagccaggcccgtctcccgctgggacacacacaggggccgggagcggggacgggacccccgaggcgggggggacgaaccgacagacagacggctgggcgcccgccccagcgggcaggcaggcaggaggaggcggaggcgggggtacgacggggagcactgggtctggggagtttcctctcaactatcgggggagaaactccccgcagccggaggaaagacccagacagtgttttcctcccgggggccgtgctcccccgccccgcgtagcggcggtcgccgccaccggcgcctccacctctaccatctcctctttctccaccacctcgggccccggtgtccccggccagcactatgcccatcttactgttcctgatagacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggccgttcatattctgtgtgttctccaagaatgcttaatcagtgtctggagtccttggtgcagaaagtacaaagtggggtggtaataaactttgaaaaagcaggaccagatccttcccctgtagaagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactaccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgtgtcaatttccctcaggttctattttcttaaaccaacctttaaaattgtcacctctgttaaggttgaactttgccaaaaaaaaaagaagttactttgtaatttttggggaaaaaagcacatacattaaaactaggtaatgttttgtatatacagttattttggatatattattgtaagttgtacaaatgtattttgaagaatatttaagaaaagcacttttgttattccatcaataaatgctctatttta

SEQ ID NO: 809 - DNA, 7333 bp, Homo sapiens
acttccttcgtctgggtggttgccccagcgacacgttgggccgaagagcggtgttgggtacccgagagacccggcggtggggaagtcacttcctcccgaagacgctgtttcctagcaaccgccctccgcctctgttattagcccctcctcctcgctcggtccaggaccggctctgcgggcgccgccaggcccagaccaagctactatcagaagttgaattctaataattagctattttataaaggtaacgagaaaaaatacactatgtctgatgaagtttttagcaccactttggcatatacaaagagtccaaaagttaccaaaagaactactttccaggatgagctaataagagcaattacagctcgctcagccagacaaaggagttctgaatactcagatgactttgacagtgatgagattgtttctttaggtgatttttctgacacttcagcagatgaaaattcagttaataaaaaaatgaatgactttcatatatcagatgatgaagaaaagaatccttcaaaactattgtttttgaaaaccaataaatcaaacggtaacataaccaaagatgagccagtgtgtgccatcaaaaatgaagaggaaatggcacctgatgggtgtgaagacattgttgtaaaatctttctctgaatctcaaaataaggatgaggaatttgaaaaagacaaaataaaaatgaaacctaaacccagaattctttcaattaaaagcacatcttcagcagaaaacaacagccttgacacagatgatcactttaaaccatcacctcggccaaggagtatgttgaaaaagaaaagtcacatggaggagaaggatggactagaagataaagaaactgccctcagtgaagaattggagttacattctgcaccttcttcccttccaacgccgaatggcatacaattagaagctgagaaaaaagcattctctgaaaaccttgatcctgaggattcatgcttaacaagtctagcatcatcatcacttaaacaaattcttggagattctttttcaccaggatctgagggaaacgcatctggaaaagatccaaatgaagaaatcactgaaaaccataattccttgaaatcagatgaaaataaagagaattcattttcagcagaccatgtgactactgcagttgagaaatccaaggaaagtcaagtgactgctgatgaccttgaagaagaaaaggcaaaagcggaactgattatggatgatgacagaacagttgatccactactatctaaatctcagagtatcttaatatctaccagtgcaacagcatcttcaaagaaaacaattgaagatagaaatataaagaataaaaagtcaacaaataatagagcatccagtgcatctgccagattaatgacctctgagtttttgaagaaatctagttctaaaaggagaactccatcgacaactacctcttctcactatttagggactttaaaagtcttggaccaaaaaccttcacagaaacagagcatagaacctgatagagcagataacataagggcagctgtttatcaggagtggttagaaaagaaaaatgtgtatttacatgaaatgcacagaataaaaagaattgaaagtgaaaacttaaggatccaaaatgaacagaaaaaagctgctaaaagagaagaagcattagcatcatttgaggcctggaaggctatgaaagaaaaggaagcaaagaaaatagctgccaaaaagaggcttgaagaaaaaaacaagaagaaaactgaagaagaaaatgctgcaagaaaaggagaagcactacaagcttttgaaaaatggaaagagaaaaagatggaatatcttaaagagaaaaatagaaaggagagagaatatgaaagagcaaagaaacagaaagaggaggaaactgttgccgagaaaaagaaagataatttaactgctgttgagaaatggaatgaaaaaaaggaagcttttttcaagcaaaaggaaaaagaaaaaataaatgagaaaagaaaggaagaactgaaaagagctgagaaaaaagataaagataaacaagctattaatgaatatgaaaaatggctggaaaataaggaaaaacaagaaagaattgaacgaaaacagaagaaacgtcattcctttcttgaaagtgaggcacttcctccgtggagccctccaagcagaactgtgttcgcaaaagtgttttgataattctagttcttacattatttggttatttatcggtttgccaatattagccatagatttaaaaccattcaattatttatagttagaggaatatattttaattaaatgccagacactcctgctgacaatgaaagaaatactttggaatgtaatcagtgaaagcatttttttgaactgtagataaactgcctcaaacaaagacctaataatcagattgtttttaccattaagatacataagattttatcatgtcctgataattcttatggtggagtgattcatgatctttttcattaagctctgtatgttatttaagtatatttaattccagtaataaaaaggaaatcatctaggtaccataatgatagaaattattccttttgtggatgattgtgaatctagattcaggtttttaaatgaagggtcgctgggaagtgcgcatatattattccttctgaaactgatgtttagctcaaagcagttgcatttgtactgtgctagttagaattttcatcagttgaggcagtagctcagtagaactctaatcatcaaggctttttatttaagaattttgccttatgttttaatatgagtgtactttatctgttccaggcttatgtgataatcataggtactttataatgagtccacctctgaaatttttctttctgaattctatctcactttattatttcagtgataccaaaagacatcaatgtcacagtagtgatatacttatgtattagttatggaaattccacaggagttcaaggtcattatcactataattattttcctgactaaagccataaaggtgatttaggcaattattgtcatcttagctagtcctgttttatagcttatattcagcagacagctgtatgggaaggtaaatatgttgacaatgtccacaaagcctttatttatttatttatttgatctctgcatgtcctcgtagtaactggtctcatacttgacctggtcatctggtttaagacagaccaagtgtatgctcacggagctgaaatgcattagtcagttgtgcaatgaggagatgatggatgagaatatatagttcctatttattgagcatctaatatataatctctactggacctttacaaatgtatttaacatctttacaacaacttttcagggtaggtgttaccggcttcatcttacatataaaaatactggcgctcagataaaccaagtaacttaccgtccatctggagtgtgcctgagttgagatcaaacgggattcagtacgtctgactgaatctgcctccttctgaaatctctatgctctttttcacacttctctgtagcctcagagactgccaagttctgtcaagacctctgcataatatcaacgttacaaacacgttttaacttttagagcctaaaatcatgtattgttatccaaagatgatctttctctacagaaatagctgcttgttcttagagatggtggaggtcattaaatctataaagtgagataaaaatccataagatttcatgagttactcaggcatcttataactactatcagaatatcagaaaactcagcaagttatgtgacaaaggctttgagatgatcactccagacgttccacatactgagcatcagccttcttgctgcagtgcatgtgcaagataagatgtcataggcagctttgtaagattgtatcagtgctatagacaattaagagaaatttcatagataaaactagaaccctttctatatggccagaactgtaatactttatgaaattgatctgattatcagcaatatgtagtatcagcatggaatttaggacctctcttactcattcctgtgtcccccatagtaccaaaaacagtgcctgccaaaatagattaaaagtgtttattgtattagctgtttagagctgaaaagatatttacaaattccagggaagtaaaaggaaaaaaactgaaaaaggtacagctacttttggggatgtgagatcatggatgtgtatcttatagatttcacattatttatttactttccattattttcttctacattatcatatttagtggctaaccattattacttcttaggttgttgtgagaaccgagttaattaatgtaaactatttgacacataataaggacttaaatgttcattgttgtcattattgatttattaccatgagccctacatttccccattcatgagtgtgcgaacattaacatagatagggttgataatggttatttgacattacacatttttaggaagaagaaatttctgtcttgctggccagtccaggctgtaacactcaaaaaaacaaaacaaaacaaaacaaaacaaaaaaacagaaagatgccttgtattagggccttcctaaaaagaaagctaagtaagtattaatttcttaggattgcttctgaggtaggatgaggtgtttgcatagacccaacaagtcattcacttcaaattttttttgtcttactatgataaataacatattatttcctgtttacagcaacctgcactgaaattaactagttgaataaaatcacctcttctagcacaaataaagctgagttcggggaggtgggtgaaaatacagtactgttgtttacttcctaagatccaagggagagaatcaagcttggtaatattctcttgaatatacatttacctatttaaaaggtatgattttcccatatttccttaggaagtatgtcatgtcaatatagatatttactcattaggtttacattaatttgtattataagggaatgtttaattcaaattaaggacattaaaagtatatagactttcatataaaagttccggttttataaattgcgttgatcacttaaagaatgcagagatctcaaagtaaagaaaacaaattttatgaatattttaaaacattacttaaaacaagtttccttagaaagcacatttgtggataaatttaaatattaatactaaataataaagtagtatacagaatttaaatttcataataatgaagaaagtggtaatgctatttaacttaaaagatgcaatatggcattttagatcaagaggttaaagttttcttaatgaaagaaagtaacgatttatgggataaaaatattccagtggtttgtatttgcttcatacttcaaaagtgttagtccatttattgtttaaagttatattgaaactgatattttcactgctgccaaagcagtacctgacagtagataggtatccacagtcttatgttccttagagttatagaactatgcctctgaaaggggttttaatactttaataaacctggcctaaactgttttatttctaagttgaagaaactgattgtcaagtactttgacttgtccaatctcatacaactaactatggtacatctagagttagatctcagtatcaggggtcccagttgtattctgctcaccattccacaatttcgatattgataaaactttcacactaacttttgaactgtggttattattaatttagttgattcatgtcctcttatttatctccttactcctccactgctgccttcataactgtccaccagatcaaagctatttgggtacctacactttaaagtgaggggaaataatgaagtttcttaaatcctgtgtcatggactaagatacaataaagaaaaggaatttcacaaagtaggggaaattacgtgttagttataatcattcccaagaataaactagtaaaagaaacttagatttccctaatttaatcttgactccgattttgatagtgctatataaaaaggtatttaaacccatatgcttccttttacataaaagaaagatatcaactttcctagtttgcatttacactggctaataggataataaaatgctgtgtaaatgttaaactggaagtttctctgagttatttttactttaaaatttcatgtgattatgccattttgaatatgtatattacatgtaattgtataatgttaactcgggtaggcaaaattcttggtattaaatttaggatgttttaaaaattattaagaagatattaatgtctgctttttgatagcatatattttcatgtaatgtttagtgtattaaaatcaaccattcaagatttattttattgggtgacactattgactgtgttccaaaatgcccatagtgttaggaaatgtggtgtgagttttatttgtgggctaaggataaaataatcatatgctaatataccttttattataaatgactaaaaatttggatataaaactgatgttttactacacaaattacagagagagataatataattatataattattaaataattagaaaatgcaaataagcaaaagtcacccatgttcccagttctcatctcctgaagatagttataactaacatattattttgtactcttcctgttaattagtttctagtgtactttctcctgtagctgaaattaagctgagaaaaaaggaagagatagttcctccctcctctttctctctcccactctgtctctctcctgtgctatctgtgtgtatatacaaatatgtatgcatatatatataatgatgtacataatatatataaaatacaaatactaatgtgcatattttcaaacatacacatattttttattatttgaaataagaatgagtcagactacatatttggtagccagatttttttcactcagtgatatatcatgaacatatttccatgctaatataattttctaataattttagatgctgtaactacaatttcattgttaatgggcaatttgttgctttacaaatggtaaattatatgataaataatatgatcattattcttgtagccaatatcattattagaaatgatggaccgcattaaagctataaaattaaataagaatttataaatgtaaggagttattcagacatcttgtatctagtattacaatatcagaaaactcagcaggttatatgacatatacactttgagatagtcactcagaggttttcacatacaggattaaccttgctgcagtgcgtgtgcaagattaaaaaagatgtcacgggtcactttgtaatgtcatatcgttgctgttgataaataaaggaaatgttataaataaaa

SEQ ID NO: 810 - DNA, 1363 bp, Homo sapiens
cgccgccgcgggctcaagcggggcggccgggccagcgcggggcggcggcgggcaggggcggcgagtgcgcgggcgctcgccgccgcccttctcggcgggcagcgcgcgaggaccaggccgaggaggaagtggcggcggcggcggcgggactgcgcgccccagctccgatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccccctcaggggagttccgcgctggggatttgtgctgtgatttgggcaaatcattccaggtctttgggcctccacccccttgtctctag

SEQ ID NO: 811 - DNA, 852 bp, Homo sapiens
atgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggtacttggggtggggaagcagggaaggctggtgcgatctattccttgggctccacgtccgagttcatggtgcgccgctgtgctgggagctgcagtggtaatgtgtgggacaccttga

SEQ ID NO: 812 - DNA, 2682 bp, Homo sapiens
aacgatcccagtgtcggttgcgggatccgcctcctctcagtttgcccctttagccctccacctttcccttctcctctctcgcatttccgccagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactgtgagtaatgatcctcaagtgagaacatgggattttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaacaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 813 - DNA, 1142 bp, Homo sapiens
acagtgtcatggaggccgcggcggtgacggtcacccggtcggctacacggcggcggcggcggcagctgcaggggctggcggccccggaggcggggacgcaggaggagcaggaggatcaggagccgcggccgcggcggcggcggccgggaaggagcatcaaagatgaagaagaagagacagtctttcgagaggtggtcagtttttccccggaccccctgccagttagatattatgacaaggacaccaccaaaccaatcagcttttacttgtcttcgctggaggagctcttggcgtggaagccccgcttggaggatggctttaatgtggccctggagcccctggcgtgtcgccagccccctctgagcagccagaggccccggactttgttgtgtcatgacatgatgggcgggtacctggatgacaggttcattcagggctcggtggtgcagactccctatgctttctaccactggcagtgcatcgacgtctttgtgtacttcagccaccacaccgtcaccattcccccagtgggctggaccaacactgcccacaggcatggggtctgcgtgctggggactttcatcacggagtggaatgaagggggaaggctctgtgaagccttcctggccggggatgagcgctcgtaccaggcagtggctgaccggctggtccagatcactcagttttttcgttttgatggctggctgatcaacatcgagaactcgctgagtctggccgctgtggggaacatgcctcctttcctgcggtacctcaccacacagctgcaccggcaggtcccagggggcctggtgctctggtatgacagcgtggtgcaaagtgggcagctcaaatggcaagacgaactcaaccagcacaacagggtcttctttgattcctgcgacggcttcttcactaactataactggcgggaggagcacttggagcggatgctggggcaggctggggagcgccgggctgatgtgtacgtgggcgtggatgtgtttgctcgagggaacgtggtcggaggccgattcgacacagacaagtcgttggagctgatccgaaagcatggcttctccgtggctttgtttgcccccggctgctccgtgtttcctggcgttggcaatttactgtgctgctga

SEQ ID NO: 814 - DNA, 1503 bp, Homo sapiens
agccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatcaca

SEQ ID NO: 815 - DNA, 1842 bp, Homo sapiens
tcggggtgagggccgtccgcggcctcgctttcgcctcctccgagccgggccggcgatggccgcagctgtgaggcgagcagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcagaatgaaacttccgcatgtttcgaagacccatgtctcggggcacatggttcgcatttcagtttaagtaactttctgctgtgatgaaactaacccgcgtggcctcttcccgtcctgtgtgccgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatcaaaaaa

SEQ ID NO: 816 - DNA, 3635 bp, Homo sapiens
aaggaggagtgcactggccgggatcggtgcagcgctcacactcactcacagtcactctctctgagcgcgtctcgctcgctctcatacacgcccggagcccaggagcgctcaggatcccgagcgccgcgaaaaagttcccccggcttttgctggagactcatcgctttgggaagtgcatttgcttcgtggctccgccgagcctgctgaatcctgtcctcgcggctcgggaccccgggatcgctgaccgctgccgccgccgcctctgcctcccggactatcggcagcctcggcaacaatagtggcggccgcccccagcgaggctccgggagcccttgcctgcgggggtccggggactcgagccggcctccgcctcccggacgcacagccagcgtggtccccgcgtgcaacgcgagcgccggggagtggctcctgctttgcccctcgtgggggccgagccaagaccagtctgcaaactccatcccgccggctggaagaagtcgcggagccggcaccaaacccgcagcgtcttcccgcgcggatcccgggacttaaaaagccggggccaccccggcccaggacgggatgcgggtcggtccggtgcgctctgccatgagcggcgcctcgcagccccgcggcccggccctgctcttcccagccacccgaggcgtcccggccaaacgcctgctggacgccgacgacgcggcggctgtggcggccaagtgcccgcgcctctccgagtgctccagccccccggactacctcagcccccccggctcgccctgcagcccgcagcccccgcctgccgctccgggggccggcggaggctccgggagcgcgccggggcccagccgcatcgccgactacctgctgctgcccctagccgagcgcgagcatgtgtcccgggcgctgtgcatccacactggacgcgagctgcgctgcaaggtgtttcccattaaacactaccaggacaaaatcaggccttacatccagctgccatcgcacagcaacattactggcattgtggaagtgatccttggggaaaccaaggcctatgtcttctttgagaaggactttggggacatgcactcctatgtgcgaagccggaagaggctgcgggaagaggaagccgcccggctcttcaagcagattgtctccgccgtcgcccactgccaccagtcagccatcgtgctgggggacctgaagcttaggaagttcgtcttctccacggaggagagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaata

SEQ ID NO: 817 - DNA, 4723 bp, Homo sapiens
actgccgctgccgcggctacctgcggttcatctccgcacattccacacgcggcccaaacggtctctctctctctctctcaaacaccgcctttccgtctttgttttatcttgagtagcttagaaagattggagaagaaagcttacgtggaatgaaaatcaacttttatggatattttgaggactaaaagaataaatagggcgtccgtactgtagcgaaagtgcgactaaggttaggcatctggatttcccccgtagccctctttcaccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctctcaagctctcgcctttcctatcagcctgctgccctgggcgttggatcagctgacctggcttatccagtagtgtttgctgctggcttaaatgctacacaccctcaccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggagtcgcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgtactttacagcctcctgtcctgtaggttgtctgaagacctcgtaaccccttccccacccctgccccagtgcaggtctgggaaaggggagagtggtgcgttgtgaagcgcagaaagacctcaagtgtctgggcaagcctgttttgagtcgggtgtggcctcttaggggctgtataccctggggtttcctgggtcaggaaacttcttagtatttctctttccctggtcccctatcaggggcttgaatttgaatattcagttggagaatgcatttaaaatacacccatagtaaaatctccataaaatgc

SEQ ID NO: 818 - DNA, 2238 bp, Homo sapiens
acacgccgcgctgaggcccgcgggcccgtcatggaggcgcccaccgtggagacgccccccgacccctcgcccccttcggccccggcccctgccctggttccgttgcgcgccccggatgtggcgcggctgcgcgaggagcaggaaaaggaagaaggtagataatgactataatgcccttcgagaaagactcagcaccttgcctgataaattgtcttataatataatggtaccatttggcccttttgccttcatgccaggaaaacttgtccatactaatgaagtcactgttttactgggggacaactggtttgcaaagtgctcagcaaagcaggctgtaggtttagttgagcaccggaaagaacatgtaagaaaaacaatagatgacttaaaaaaagtgatgaaaaattttgaatccagagttgaattcacagaagatttgcagaaaatgagcgatgctgcaggtgatattgttgacatacgagaagaaattaaatgtgacttcgaatttaaagcaaaacaccgaattgctcataaaccgcattccaaaccaaaaacttcagatatttttgaagcagatattgcaaatgatgtgaaatccaaggatttgctagctgataaagaactgtgggctcgacttgaagaactagagagacaggaagaattgctgggtgaacttgatagtaagcctgatactgtgattgcaaatggagaagatacgacatcttctgaagaggaaaaggaagatcgtaacacaaatgtgaatgcgatgcatcaagtaacagactctcatactccttgtcataaggatgttgcaagttcagaaccattcagtggtcaagtgaatagtcagttgaactgttcagtgaatggttccagttcttaccacagtgatgatgatgatgatgatgatgatgacgacgacgacgacaacattgacgacgatgatggtgataacgaccatgaggctttaggggttggagataattctataccaacaatatatttttcacatactgttgagcctaagagggtccgaataaatactggaaagaataccactttaaaattcagtgaaaagaaagaagaagccaaacgtaaacgaaagaacagcactggcagtggccactctgcccaggagctgccgaccatcaggacgcctgcagacatttacagagcctttgttgatgttgtgaatggagaatatgtccctcgcaaatccatcctgaagtctcgaagtagagagaatagtgtgtgtagcgacactagtgaaagcagtgctgctgaatttgatgataggcggggagttttgaggagtatcagctgcgaagaagccacttgcagtgacaccagtgagagcattttggaagaggaaccacaagaaaatcaaaagaaacttttgcccttatcagtaacacctgaggctttttctggaactgttatagaaaaagaatttgtatcaccttccttaacaccacccccagccattgctcatcccgcactacccactattccagaacgaaaggaagttctgttggaagcatctgaagaaactggaaagagggtttcaaagtttaaagctgccagattgcaacagaaagactaggccctgtctaggaaatgggaatttacatcctaaaacctagttgttcatttgtttagagtatctatagcaaaataggttacatgtagtttgaaataaggtatcctgagttactttggcaacaagttcttttacccttacccgtggtatttgaaaaaaatcaaggtaactgtctgaatactttaatatcagcttgttttgtgaattctctgaatactgtcaacactcttatctaagtttgcctttatgatgcagtggcagcattttgaattacttttcaaagaatactgttcatatgcattgtttttgtgtttcaaactaaatacaggcagttttgtgccagctgtgatattgtgcataccatatggaccattttaaagaaaattttaaaatttcaaatagattcaacaattacattacttgctttcacattttaaaggcactttaaaaaaatctacttctcttgtaggttttgcggctagttggctattcaagaaacctcgcccctctgaatgtcatactgtaatctttaaggaagaaagctacatgaattaattgtactctatgggaaaatttctttggaaagatattttgtaaaacttttttttccaagtaaaaactttatgaaacttggtctc

SEQ ID NO: 819 - DNA, 1662 bp, Homo sapiens
gccctcgcgctgtcgccgccacagtctgcgacgggacccggcgtgcccatgtgtcaggtgggcgaggactacggggagccggcgcctgaggagccgcccccggcgccgcggcccagccgtgagcagaagtgtgtgaagtgcaaggaagcgcagcccgttgtggtgatacgagccggagatgccttctgcagggactgtttcaaggccttctacgtccacaagttcagagccatgctgggcaagaaccggctcatctttccaggcgagaaggtgctcttggcgtggtctggggggccttcgtccagctccatggtctggcaggttcttgagggcctgagccaagattctgccaaaagactgcgctttgtggcaggagtcatctttgttgacgagggagcagcctgtggccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggcccgactcaaggggaggaacagccaccccagcccccgctggacccccagaacctggcaagaccgcctgcccctgcccagactgaggctctttcccaactgttctgctcagtgaggacactgactgccaaggaggagcttctgcagaccctgcggacccacctgatcctccacatggcccgagcccacggctactccaaggtcatgactggggacagctgcacacgcttggctatcaagctcatgaccaacctggcgctgggtcgaggggccttcctggcctgggatacgggcttctcggatgagcggcacggggacgtggtggtggtgcggcccatgcgggaccacaccctgaaggaggtcgctttctacaaccgcctgttctccgttccttctgtcttcacaccagccgtcgacaccaaggcccctgaaaaggccagcatccaccggctgatggaggccttcatcctcaggctgcagacccagttcccctccactgtcagcactgtgtacaggacaagtgagaagctggtgaagggcccccgggatggccctgctgctggcgactccggcccccgctgcctcctctgcatgtgtgccctggacgtcgacgccgctgacagtgccacggcttttggggctcagacctcctcgcgtctctcccagatgcagtcacccatccccctgactgagacccggacacccccggggccctgctgttctccaggggtgggctgggcccagcgctgtggccagggggcctgcaggagggaggacccccaagcctgcattgaggagcagctgtgctacagctgccgcgtgaacatgaaggacttgggcctggggcttgcaggagatccgggactgtctgattgaggacagtgacgacgaggcgggccagagctgagcgtgaggacgtgcttgccgggacagcaggcagtggccacctggtacaccacactggagccggaaggcaaggacgggggactggcctctgattgtccatttgtataaataaaacattttttaatt

SEQ ID NO: 820 - DNA, 1670 bp, Homo sapiens
aagaaggcactccattctggctttcacaaatacagctctgcaacgcgtttgccctgataccatgtctcttcgactttccagtgcatccaggaggtcctgtcctcgtcccaccactggatcactcagactctatggtgggggaaccagctttggtactggaaattcttgtggcatttcagggattggaagtggcttctctagtgccttcggaggcagctcatcgggaggaaacacagggggaggtaatccctgtgctggcttcactgtgaatgagcgggggctcctttctggcaatgagaaggtgaccatgcagaacctcaatgaccgcctggcatcctacctggacagtgtgcatgctctggaggaggccaacgctgacctggagcagaagatcaagggctggtatgagaaatttgggcctggctcttgccgtggtcttgatcatgactatagcagatatttcccaataattgatgaccttaaaaatcagatcatcgcatccaccaccagcaatgctaatgctgttctgcagatcgataatgccaggcttacagctgatgatttcagactcaagtatgaaaatgagctggctcttcaccagagtgtagaggctgatgtcaatgggttacgaagagttttggatgaaataaccctgtgcagaacagatctggagattcagtatgaaaccctgagtgaggagatgacttacctcaaaaagaaccataaagaggaaatgcaagttctgcagtgcgcagctggaggcaacgtgaacgtggagatgaacgcagcccccggggtggacctcacagttctgctgaacaacatgcgagctgagtacgaagcccttgcagagcagaaccgcagggacgcggaggcctggttcaacgagaagagcgcctccctgcagcagcagatctctgaggatgtcggagccacaacctcagcccggaatgagctgactgaaatgaagcgcactcttcaaaccctggaaattgaacttcagtctctcctagccacgaaacactccctggagtgctccttgacagagaccgagagcaactactgtgcgcagctggcgcagatccaggctcagatcggggccctggaggagcagctgcaccaggtcagaaccgagaccgagggccagaagctggagtatgagcagctcctggacatcaagctccacctggaaaaagaaattgagacctactgtctccttataggaggagatgatggagcctgtaagtctgggggttacaagtctaaagattatggatctggaaatgtgggaagtcaagtcaaagacccagccaaagccatagtggttaagaaagttcttgaggaggtagaccaacgcagcaaaatacttaccaccaggctccactccctggaagagaaatctcaaagcaattaatttgagatgcaacagagaacgtatgccacatagcccctgcgaagaaaaggcattatgtatctgtccagaaaaatgtgcatgtctaagaaaaatgtctaacctgttgtctttctgttactttctttctgggcaatcaatgacagcatctccccattcatctagaagaatgccacacacaaatatgactcatttgattatcctacagaaatctgttgtcaattctttgtattcaataaacctcttctttagcaagtta

SEQ ID NO: 821 - DNA, 2679 bp, Homo sapiens
atggaccagccagaggccccctgctccagcacggggccgcgcctcgcggtggcccgcgagctgctcctggctgcgctggaggaactgagccaagagcagctgaagcgcttccgccacaagctgcgcgacgtgggcccggacggacgcagcatcccgtgggggcggctggagcgcgcggacgccgtggacctcgcggagcagctggcccagttctacggcccggagcctgccctggaggtggcccgcaagaccctcaagagggcggacgcgcgcgacgtggcggcgcagctccaggagcggcggctgcagcggctcgggctcggctccgggacgctgctctccgtgtccgagtacaagaagaagtaccgggagcacgtgctgcagctgcacgctcgggtgaaggagaggaacgcccgctccgtgaagatcaccaagcgcttcaccaagctgctcatcgcgcccgagagcgccgccccggaggaggcgatggggcccgcggaagagcctgagccggggcgcgcgcggcgctcggacacgcacactttcaaccgcctcttccgccgcgacgaggagggccggcggccgctgaccgtggtgctgcagggcccggcgggcatcggcaagaccatggcggccaaaaagatcctgtacgactgggcggcgggcaagctgtaccagggccaggtggacttcgccttcttcatgccctgcggcgagctgctggagaggccgggcacgcgcagcctggctgacctgatcctggaccagtgccccgaccgcggcgcgccggtgccgcagatgctggcccagccgcagcggctgctcttcatcctggacggcgcggacgagctgccggcgctggggggccccgaggccgcgccctgcacagaccccttcgaggcggcgagcggcgcgcgggtgctaggcgggctgctgagcaaggcgctgctgcccacggccctcctgctggtgaccacgcgcgccgccgcccccgggaggctgcagggccgcctgtgttccccgcagtgcgccgaggtgcgcggcttctccgacaaggacaagaagaagtatttctacaagtatttccgggatgagaggagggccgagcgcgcctaccgcttcgtgaaggagaacgagacgctgttcgcgctgtgcttcgtgcccttcgtgtgctggatcgtgtgcaccgtgctgcgccagcagctggagctcggtcgggacctgtcgcgcacgtccaagaccaccacgtcagtgtacctgcttttcatcaccagcgttctgagctcggctccggtagccgacgggccccggttgcagggcgacctgcgcaatctgtgccgcctggcccgcgagggcgtcctcggacgcagggcgcagtttgccgagaaggaactggagcaactggagcttcgtggctccaaagtgcagacgctgtttctcagcaaaaaggagctgccgggcgtgctggagacagaggtcacctaccagttcatcgaccagagcttccaggagttcctcgcggcactgtcctacctgctggaggacggcggggtgcccaggaccgcggctggcggcgttgggacactcctgcgtggggacgcccagccgcacagccacttggtgctcaccacgcgcttcctcttcggactgctgagcgcggagcggatgcgcgacatcgagcgccacttcggctgcatggtttcagagcgtgtgaagcaggaggccctgcggtgggtgcagggacagggacagggctgccccggagtggcaccagaggtgaccgagggggccaaagggctcgaggacaccgaagagccagaggaggaggaggagggagaggagcccaactacccactggagttgctgtactgcctgtacgagacgcaggaggacgcgtttgtgcgccaagccctgtgccggttcccggagctggcgctgcagcgagtgcgcttctgccgcatggacgtggctgttctgagctactgcgtgaggtgctgccctgctggacaggcactgcggctgatcagctgcagattggttgctgcgcaggagaagaagaagaagagcctggggaagcggctccaggccagcctgggtggcggcagcagttctcaaggcaccacaaaacaactgccagcctcccttcttcatccactctttcaggcaatgactgacccactgtgccatctgagcagcctcacgctgtcccactgcaaactccctgacgcggtctgccgagacctttctgaggccctgagggcagcccccgcactgacggagctgggcctcctccacaacaggctcagtgaggcgggactgcgtatgctgagtgagggcctagcctggccgcagtgcagggtgcagacggtcagggtacagctgcctgacccccagcgagggctccagtacctggtgggtatgcttcggcagagccctgccctgaccaccctggatctcagcggctgccaactgcccgcccccatggtgacctacctgtgtgcagtcctgcagcaccagggatgcggcctgcagaccctcagtctggcctctgtggagctgagcgagcagtcactacaggagcttcaggctgtgaagagagcaaagccggatctggtcatcacacacccagcgctggacggccacccacaacctcccaaggaactcatctcgaccttctga

SEQ ID NO: 822 - DNA, 2347 bp, Homo sapiens
gcgggcaggcgactcctgtcccgggtggaggcggcggagccggagccgggggagggggcagcggctgtctcacggaccacggcggcgcccgcagctcctcaccgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtatttt

SEQ ID NO: 823 - DNA, 3073 bp, Homo sapiens
tctgccgttgggtgaggcgcggagcgaagtgaagggtggcccaggtggggccaggctgactgaaaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgctgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaa

SEQ ID NO: 824 - DNA, 12394 bp, Homo sapiens
gagaccgctgcaagtcccggggccctgcctctatcgtcctaggggttccgcgggcaggagcaacccagaagcaccggtgaggccagcgcgtcctcgcagccatgagcagtgagcaggataaatcggccagcaaagaaaaatccaagaaaccagtaagatttctaccacagctgtctatggagaaattagccagcaaagaaaagttcaaggcaccagcaagagctttaccacagctgtctatggtgagtacaaagccccactggcagcaggcagctccatcattccatttgagtgtaaagcaggatgatgagagtccagaaccatttagtgttaaaaatgaacagtcccatgctgaatacatggaacgttttggaaaaaagggcaaattaccccaccaagttgatgatagttatgttggaccatctacttccaaatcaaagggcaaatctccacataaagaacgagaaaactttagaagtactcttgttaatgtcattatgcaacaagatgctgacttagactcagctgtccctgatggaagcacaattccaaaaccgaccgcttctgctatagagaaagacatcttgagatattactattatattcaccatggaattgatacagaccatgtagccccaatggaagattcttggctagaacacgtactggatttagttccacaacatctgaaagtcttcactgacagcatagttacattatctgatgaaatgagagaggattatcttcttagtgtaaggaaatccatagttgattttgttttaaaagatcctcgagagaaaggagatgataagaagacagatgaacttccagcccatcgtgctgaaatggaaattctgccaaaaccttggaggaaatcttttttagctgcaagcagttatattagggatcacttgaatgcaatgaaccccacaatgctggctgtactagatttgtggcacactaattttaaaaaattacgtttagttgatatcaaagaatttcataattgccaggatgcattagagctgtcaagttttcagaacattatcatgagacacatggactctgccaaagagactctacttaaaatgtggtttccagaagtgcagaatatttattaccaaggtaataaaaaaaagcaattgccaactggtgacagcagtgccaaattggaatcttttttcaactgtgctgctgcacttatgactttacagctgcaggacctcactttagtctccatgcaagatttcacggacttaattgcacaacccccagattctgttagagcttttgaacatccaggtttcatcatgaggctgattcttgataatgacaccattaagtttgaacctgagttgagtgactatatagatatctttctaaatgtttatgacgtcatgattaaagctgtcagttttgtgccaagagttgagacaaaattgtattccaagtgggaaagtaagtctaaaccaacaaccttgaagcccataattctgaatgaaattgtagatgctcacaaagaaaagatcaaggaagttattatgaaagagagtgtggcacctactgagcacctcagactctatgacaagtatgactttttaattaccagaaaagctgagcgagatgttgataacttcctcgcagaaaatcatagttatgaaaaaataatagatgaaatttgcaaataccagaaactaatagaggaaatacagtacacatccataaagactattcgtttaggaatgtttgaaatgcactgtgaggaattaatcagagctttggtgaagcgagcagatattatttgtgggaaacttctagctaaaatgttcagagatcatcaggaagtaaatacaagattatgcgatgaatttgagaggatagctgaaaaagctcttagcactcctccaaatacagcagaactaatggaaatgaaggcttacattcagaaagtggaggtaactgatatgattgaactagaacagagattagtggattccaaaaactgcctcgccttcctcatcgagtatgtcaacttttctccagcagacatgaggctaaataatagtgttttccagtggtatggaaggatgggagaaatttttgaagaacacaggaaaatcattaaagagaaaatagaacaatatcaagaaggtctgaagttacggtgtgaacggtttgtggaggaattggagagttatgctaagcaatcagaagaattttattcatttggagatcttcaggatgttcagcggtacctaaaaaaggctcaaatactgaatggaaagttggatttagctgcagataagattgagcagtttaatgctgaagaggaagcatttggttggctaccatctgtatatcctcaacgtaaaaaaatccaagatggcttgaacccttatcttcgtctttatgaaactgctgtcgaatttagcagcaactatagagcatggacagaagggccatatcataaagtgaatccagaccaagtagaagcagatattggaaattactggagaggattatataaactggagaaaacctttcatgattctccatatgcattggcaatgacaaaaaaagtaagatcaaaggtggaagatttcaagcagcacattcctctcattcaagtgatctgtaatcctggtttgcgccccaggcactgggaggccatgtctgccattgttggttaccctttgcagccatcagatgactccacagtctcctcttttttagacatgaatctggaaccatatatagaccgatttgaaggtattagtgaagcagctagcaaagaatattctcttgaaaaggcgatggagaagatgattactgagtgggatgcagtggaatttgtcatccattcttatagagaaactgggacatttattttggcatcagttgatgaaattcagatgttgttggatgaccatattattaaaacacaaactatgcgaggatctcctttcattaagccttatgaaaaacaaatgagagaatgggagggcaagctcctactgcttcaggagattctggatgaatggctcaaagtccaagccacgtggctgtatctggagcccattttcagctctccagacattatgtctcaaatgcctgaggaaggcagacgatttacagctgtggataagacatggagagatataatgagaagtgtcatgcaggataaacatgttctgacagttgtaaccattgacagaatgctggaaaggctgaaaaaatctaatgaacttttggagctcattcttaaaggacttaatgaatatttggaaaagaaacgcctctttttccccagattcttttttttgtccaatgatgaacttcttgagatactatctgagactaaagatcccactagggtgcaacctcacttgaagaaatgttttgaaggaatcgcaaaggtagaatttacggaaactttagacattactcacatgaagagcagcgaaggagaggttgtagaactcatagagattatttcaacagccaaagccagaggtcaagtggagaagtggttggttgaattagagagagttatgattaactccatccacaaggtaactggagatgcaacttttgcctatacaaaatatgaacgaattaactgggtaagggattggcctggacagactgttctctgtgtatcccaaatcttttggacaaaagaagtacaaacagctattccaatggggataaaggctcttgagcaatacttgaaaacatgtaacagacaaattgatgatattgtcactttggtgcgtggcaaattgtccatgcagaatcgcgtaactctgggagcacttgtggtactggatgtccatgctagagatgtcctctcatcacttgtaaaaaaaaatattagcgatgactctgactttgaatggttaagtcagcttaggtactactggcaagaaaatcatttagaaacaaaaatgatcaatgctggtttgcgatatggatatgaatatctgggtaattcccctaggctggttattacaccactcacggatagatgttacagaaccttatttggagcccttcatttgcaccttggaggagcacctgagggtccagctggcactgggaagactgaaactaccaaggatttggcaaaagctgtagccaaacaatgtgttgttttcaactgctctgatgggttggattatttggctttgggaaaattctttaagggactgttatcttgtggagcctgggcttgctttgatgagtttaacagaattgatttggaagtactctctgtggttgctcaacaaatccttactatccaaagaggtattaatgcaggtgctgatatactgatgtttgaaggaactgaactaaaacttgaccccacatgtgctgtctttataacaatgaaccctgggtatgctgggcgatcagaactgccagataacctgaaggctctctttcggacagtagcaatgatggtacctgactatgccatgattgctgaaatagtcctatactcctgtgggtttgtcactgctcgaccactgtctgtaaaaattgtggctacgtatcgcttgtgttcagagcagctgtcatctcaacatcactacgactatggaatgagagccgtgaagtcagttcttactgctgctgggaatctgaagctgaaatatccaaatgaaaatgaagaaattttgctgcttagatctatcattgatgtaaatctgccaaaatttttatcccatgatttaccactctttgagggaattacttcggatttgtttcctggggtaaaattaccaaaaccagattacaatgatttgctggcagctatcaaagacaattgtgcctccatgaatttgcaaatgactgcattcttttccgagaagattcttcaagtatatgaaatgatgattgtgcgtcatggttttatgattgttggagaaccatttggaggaaaaactagtgcatatcgtgtcttagctggagcactaaatgatatatgtgaaaaggggctaatggaagaaaacaaagttcaaataactgttttaaatcctaagtctgtcaccatgggccaactgtacggacagtttgattcagtgtcccatgaatggtctgatggggtccttgctgtcagttttagagcatttgcctcttcagtgactccagataggaaatggttaatttttgatggcccagtagatgcagtgtggattgagaatatgaacactgtgctggatgacaacaagaagctatgtctgatgagtggggagattattcagatgtcaccacaaatgaatctaatttttgagccaatggatttagaagttgcttcccctgccactgtttccagatgtggcatgatttacatggagcctcacatgttaggctggagaccactgatgttgtcctgggtgaatctgttacctgcgtcagtcagtgttattcaaaaggaattcataatgggcttatttgacagaatggtccctgtttcggttgaatttattagaaagcatacaaaggaattatctcctacttccgatacaaacttggtccggtccttaatgaatctaatagactgttttatggatgattttgctgatgaagtcaaactaaaggagagaaatgatcgagaaacttactctttgcttgagggcatttttctgttttcattgatctggtccgttggtgcttcttgtacagatgatgatcgattgaaatttaataagattcttcgagaactaatggaaagtccaatttcagatcgaactcgaaatacgtttaaattacagagtggtactgagcaaacatcctcaaaggcactaactgtcccatttcctgaaaaaggaacaatttatgattatcaatttgtcactgagggaataggaaaatgggaaccatggataaagaaattgaaagaagctcctccaattcctaaagatgtaatgtttaatgaaatcattgtgccaactctggacacaattcgatactctgcattaatggaattgctgaccacccatcaaaagccttcaatatttgtaggaccaacaggaactgggaaaagtgtttacattacgaattttcttttaaatcaactaaataaggaaatctacaaacctctgctaattaacttctcagcacaaactacagcagctcaaactcagaatattgtcatgtcaaaattggacaagagaagaaagggagtttttggtcctcctttgggcaagagaatggttgtctttgtagatgatgtcaatatgcctgctcgggaggtatatggggctcaacctcccattgagttacttagacagtggttagaccactggaactggtatgatctaaaagattgttccatgattaaactagtggacattcagatcatgtgtgctatgggacctccaggtggtggtcgaaatccagtaactcctcgatacatgcgacatttcaatattataacaatcaatgagtttagtgataaatccatgtatacaatcttctctagaatcttaacttggcatttagaaatctgttataaatttccagatgaatttctagatttgaccacacaaatcgtaaatggcacaatgactctgtataaagaagcaatgaagaatctcttgcctactccagctaaatctcactacttgttcaacctccgtgatttctcccgtgtcattcaaggtgtttgtttgtcaagaccagaaacaacagaaaccacagaagtgattaaacgtctttgggttcatgaggtccttcgagtgtattatgaccgccttctggacaatacagacagaagctggctcatcaactacattcaagaaattttgagaaactacatgtatgaagattttcatgagctttttcagcgtttggattttgataatgatggcatggtggaagcagatgacttacgcagcttaatgttttgtgatttccatgatcccaagagggaggataccaactacagagaaatcgcagatgtggataatcttcgaatgatagtagaaattcacctagaagaatacaacaatataagcaaaaaacccatgaaccttgtcttgtttcgatttgccatagagcacatcagcagaatttccaggatcctgaagcagcctcgcagccatgctctcctagtaggggttggagggagtggaaggcagtctgtcaccagattagctgcccacatggctgattattcagttttccaagttgaaatctctaaggggtatgatactactgaatggcatgaagatttaaaagtgatcttaaggaaatgtgcggaaggtgagatgcagggtgtcttcctgtttacagatactcaaattaaagaagagtcttttctggaagatgtcagtaatctgctaaatgctggggagattccaaatctctttgcattagatgagaagcaagagatatgtgataagatgcgtcagttagatcgccagcgggataaaaccaagcaaacagatggcagccccatagcccttttcaacatgtttattgatcattgccgcagccaactgcatgtggtccttgccatgagtcccattggagatgcatttcggaatcgtcttagaaagttccctgctcttgttaactgctgtaccattgactggtttcagtcatggcctgaagatgcactccaggcagttgcctcacgattcttggaagaaattgaaatgtcagaggaaatacgagatggctgtatcgacatgtgtaaaagcttccacacttctactatagatttatccaaatctttctttgttgaacttcaaagatacaattatgtgactcctacctcttacctcgaattaatctccaccttcaaactgttgttagaaaagaaaagaagtgaagtaatgaaaatgaaaaagagatatgaagtgggtttggagaaactggattctgcttcatctcaagtagccacaatgcagatggagttggaggcactacatcctcaattaaaagttgctagcaaagaggttgatgaaatgatgataatgattgagaaagagtctgtagaagttgccaaaactgaaaaaatagtgaaagctgatgaaacaatagcgaatgaacaagctatggcttccaaagccatcaaagatgagtgcgatgctgacctggcaggtgccttgccaatattagagtcagcactggccgcccttgatactcttactgcacaggatattacagtggtaaaatccatgaagagtcctcctgctggtgtcaagcttgttatggaagctatatgcatcttgaaaggaatcaaagctgacaaaatccctgacccaacaggttcagggaaaaaaattgaggatttctggggcccagctaagagacttcttggtgacatgaggtttctgcagtcacttcatgaatatgacaaggacaatattcctccagcttatatgaatatcataagaaaaaattatattccaaatccagattttgtaccagaaaaaatcagaaatgcttctacagcggccgaaggtctgtgcaaatgggtcatagcaatggattcatatgataaagtggcaaaaatagtagctcccaaaaagataaaactggctgcagctgaaggggagcttaaaattgccatggatggtcttagaaagaagcaggcagcccttaaggaagttcaggacaagctggccaggcttcaagacacacttgaattaaataaacaaaagaaggctgacctggaaaaccaggttgacctttgcagcaaaaaactagaacgagctgaacagttgattggaggccttggaggtgagaaaactcgatggagccacacagctctggagctaggtcagctgtacatcaacttgactggggatatcctcatttcctccggagtggttgcttacctcggagccttcacatccacctatagacagaatcaaactaaagagtggacaactttgtgcaaaggaagagatatcccctgctcagatgattgctctcttatgggtaccctgggagaagctgtgacaattcgaacttggaatattgctggattaccttctgactcattttccattgataatgggataatcataatgaatgcaagaaggtggcctctgatgatagatcctcaaagtcaggctaataaatggatcaagaacatggaaaaagccaatagtctttatgtgattaaacttagtgaacctgactatgtcaggactctggaaaattgcatccagtttggtactcctgtgttgctagaaaatgttggcgaagaactagatcctattttggaacctcttctactaaaacaaacctttaagcagggtgggagtacatgtatccggcttggggactccacaattgaatatgcacctgacttccgcttctatattactaccaagttaagaaatcctcattatcttcctgaaacatcagtaaaggtaacattattaaacttcatgataacccctgagggaatgcaagatcagcttctgggaattgtggtggcacaagaaaggccagaccttgaagaagaaaagcaagccttgatattacaaggagctgaaaataaaaggcagttaaaagaaatagaagacaagattttagaagttctttcatcttcggaaggcaatatattagaagatgaaactgctattaagatattatcttcctccaaggccttggctaatgagatttctcagaagcaggaagtagccgaagagacagagaaaaagattgacaccacccgcatgggctatcgtcctattgccatccattcttccatcctatttttttctcttgctgatttagccaacattgagcccatgtaccagtattcactgacctggtttattaaccttttcatcctgtctattgaaaattcagagaaatcagaaattttggcaaaaaggcttcagattctcaaggatcactttacttattcactgtatgttaatgtctgccggtcactctttgaaaaggataagctgctcttttccttttgtctaaccataaatctactgctgcatgagcgggcgattaataaagctgagtggagatttctgctaactggtggcattggactggataatccttatgccaacctttgtacatggcttcctcagaaatcctgggatgaaatatgtcgattagatgatttgcctgccttcaaaaccattcgtagagagtttatgcgcttaaaggatggatggaagaaagtatatgatagtttggaaccacaccatgaggttttccctgaagaatgggaagataaagcaaatgagtttcaaaggatgcttattattcgttgcttgaggccagacaaggttattccaatgttgcaggaatttataatcaacagattgggacgtgcattcattgaaccacccccctttgatttagccaaggcatttggagacagtaactgctgtgcaccactgattttcgtgctctctcctggagcagatcccatggctgcccttctaaaatttgctgatgaccagggatatgggggatcaaaacttagctctttatctcttggtcaaggccaagggcccattgctatgaagatgttagaaaaagctgtcaaggaaggaacatgggttgttcttcagaattgtcaccttgccacctcttggatgccaacccttgagaaagtctgtgaggagttaagcccagagtcaacacatccagatttccgaatgtggctaacgagttacccatctccaaatttccctgtgtcagtactgcagaatggagtgaaaatgaccaatgaagcaccaaaaggtttacgggctaatatcattcgatcatacctcatggacccgatctctgatccggagttctttggcagctgcaaaaagcctgaggaattcaagaaattgctttatggcctgtgtttctttcatgctttggtacaagaaagacggaaatttggacccctagggtggaatattccttatgagttcaatgagacagatctgagaatcagcgtacagcagctccacatgttcctgaaccagtatgaggaactgccgtatgaggctctgcggtacatgactggcgaatgcaattacggaggcagagtgaccgatgactgggaccggcgcacgctgcgcagcattctaaacaaattcttcaatcccgaattagttgaaaattcagactataagttcgactcaagtggcatctattttgttcctccttctggtgatcacaaaagctacatcgaatacacaaagactctgccactgaccccagcaccagaaatctttgggatgaatgccaatgcagatatcactaaggatcagtcagaaactcagctgctatttgataacattcttcttacacagtctcgttcagcaggtgctggtgcaaaatcatcagatgaagtagtgaatgaggtcgctagtgacatcttgggcaaacttccaaacaacttcgacatcgaggctgccatgaggaggtacccaacaacttatactcagagcatgaacactgtacttgtccaagagatgggacggttcaataagttactgaagaccataagagattcgtgcgtaaatattcaaaaagcaatcaaggggcttgcagtcatgtctacagatcttgaagaagtggttagcagcattttgaatgtcaaaattccagaaatgtggatgggtaaatcctacccaagccttaaaccacttggcagctatgtgaatgacttccttgcaagactaaaattcttgcagcaatggtatgaggttggtcctcctccagtcttctggctttctggcttcttcttcacacaagccttcctgaccggtgcccagcagaactacgccaggaaatacacaattcctattgatcttcttgggtttgactatgaagtgatggaagacaaagaatacaagcatcctcctgaggatggtgttttcattcacggattatttctggatggagcttcctggaatagaaagatcaagaaacttgcagaatcgcatcccaaaattctttatgatacagtgcctgtgatgtggctaaagccctgtaagagggcagatataccaaaacggccaagttatgttgctccattgtataagacaagtgagcggagaggagtattatccaccactggccattccacgaattttgtgattgccatgactcttccctctgaccaacccaaggaacactggattggacgaggtgtagcactgttatgtcaacttaattcataaccagaagacatcatttccttgttcctatttcttgttggctggctgagtagagaaagcatattttactacttaaacctttttttttgtttgtttaaatacatttgactaaagttataattatgaatttacttatgagcaaatgcagctaaacttaatatgactcatacttaaatgtaaggaaatgttctgaaataaagactaaagaaaacacactggca

SEQ ID NO: 825 - DNA, 1836 bp, Homo sapiens
atgtcttcaagacaggataaatcggccagcaaagaaaaatccaagaaaccagtaagatttctaccacagctgtctatggagaaattagccagcaaagaaaagttcaaggcaccagcaagagctttaccacagctgtctatggtgagtacaaagccccactggcagcaggcagctccatcattccatttgagtgtaaagcaggatgatgagagtccagaaccatttagtgttaaaaatgaacagtcccatgctgaatacatggaacgttttggaaaaaagggcaaattaccccaccaagttgatgatagttatgttggaccatctacttccaaatcaaagggcaaatctccacataaagaacgagaaaactttagaagtactcttgttaatgtcattatgcaacaagatgctgacttagactcagctgtccctgatggaagcacaattccaaaaccgaccgcttctgctatagagaaagacatcttgagatattactattatattcaccatggaattgatacagaccatgtagccccaatggaagattcttggctagaacacgtactggatttagttccacaacatctgaaagtcttcactgacagcatagttacattatctgatgaaatgagagaggattatcttcttagtgtaaggaaatccatagttgattttgttttaaaagatcctcgagagaaaggagatgataagaagacagatgaacttccagcccatcgtgctgaaatggaaattctgccaaaaccttggaggaaatcttttttagctgcaagcagttatattagggatcacttgaatgcaatgaaccccacaatgctggctgtactagatttgtggcacactaattttaaaaaattacgtttagttgatatcaaagaatttcataattgccaggatgcattagagctgtcaagttttcagaacattatcatgagacacatggactctgccaaagagactctacttaaaatgtggtttccagaagtgcagaatatttattaccaaggtaataaaaaaaagcaattgccaactggtgacagcagtgccaaattggaatcttttttcaactgtgctgctgcacttatgactttacagctgcaggacctcactttagtctccatgcaagatttcacggacttaattgcacaacccccagattctgttagagcttttgaacatccaggtttcatcatgaggctgattcttgataatgacaccattaagtttgaacctgagttgagtgactatatagatatctttctaaatgtttatgacgtcatgattaaagctgtcagttttgtgccaagagttgagacaaaattgtattccaagtggagaaacaaagcaaaaccaggacatttttacttttctcatattcaaaggtctgtcacctttcagcattctgaagtttcgtctcctcagaactctcattttaagattgtgtcacccttcagtgttcttggctttacatggagatgccaattatgacttccaactttgctcgaccttgaggctttgtttcctggcagcccctcccatgcatccaccttgccggaaactcattaaagcaaagcttagaccaccaaggatcagcagggtccccagggcagctgctcacttctgcacataatgacctttcaactcatgctttctctcattttggtcccttagacttttttttttgttgttatttccttagctatacgttataaaagataaagtcagctttattatcctggcatatttatgtgttttgaattgagtagttgttttctggatatctattcctcatactaccatgaatagaagtctctcaag

SEQ ID NO: 826 - DNA, 1019 bp, Homo sapiens
agggatccctgggagccgcggtgcattgtgggagaacgaaagatggcggcgcccgtaaggcggacgctgttaggggtggcggggggttggcggcggttcgagaggctctgggccggcagtctaagctctcgcagcctggctcttgcagccgcaccctcaagcaacggatccccatggcgcttgttgggcgcgttgtgcctgcagcggccacctgtagtctccaagccgttgaccccattgcaggaagagatggcgtctctactgcagcagattgagatagagagaagcctgtattcagaccacgagcttcgtgctctggatgaaaaccagcgactggcaaagaagaaagctgaccttcatgatgaagaagatgaacaggatatattgctggcgcaagatttggaagatatgtgggagcagaaatttctacagttcaaacttggagctcgcataacagaagctgatgaaaagaatgaccgaacatccctgaacaggaagctagacaggaaccttgtcctgttagtcagagagaagtttggagaccaggatgtttggatactgccccaggcagagtggcagcctggggagacccttcgaggaacagctgaacgaaccctggccacactctcagaaaacaacatggaagccaagttcctaggaaatgcaccctgtgggcactacacattcaagttcccccaggcaatgcggacagagagtaacctcggagccaaggtgttcttcttcaaagcactgctattaactggagacttttcccaggctgggaataagggccatcatgtgtgggtcactaaggatgagctgggtgactatttgaaaccaaaatacctggcccaagttaggaggtttgtttcagacctctgatgggccgagctgcctgtggacggtgctcagacaagtctgggattagagcctcaaggacattgtgtgattgcctcacatttgcaggtaatatcaagcagcaaactaaattctgagaaataaacgagtctattactgtg

SEQ ID NO: 827 - DNA, 1231 bp, Homo sapiens
cgatccggtacttggaggttcgaagctcctagtttcgggttgagaccgatgtggagggcgatgacgcgcgggttccttgacatcgaggatcagtaacacccggagtgggtggggaacgaggggggcggcccctgagctcaggccccgcccctttccggggacgtttcaccggattggctgtccttccataacgacatgcggccccgccccggcgcgcgccccgccgcgtgcccagcccgggtagctgctgcagcctacgctgcctcggccactgcctgccgcgtgcggagccggagcccgagcctgagtggcgccgggcccgacgtggggctcctgggccgcggcggcgggcgggcgatgctccagaggcctgaccagccatggaggccgaggcaggcggcctggaggagctgacggacgaggagatggcggcgctaggcaaggaagagctagtgcggcgcctgcggcgggaggaggcggcgcgcctggcggcactggtgcagcgcggccgcctcatgcaggaggtgaatcggcagctgcagggccacctgggcgagatccgcgagctcaagcagctcaaccggcgtctgcaggcagagaaccgtgagctgcgcgacctctgctgcttcctggactcggagcgccagcgcgggcggcgcgccgcacgccagtggcagctcttcgggacccaagcatcccgggccgtgcgcgaggacctgggcggctgttggcagaagctggccgagctggagggccgccaggaggagctgctgcgggagaacctagcgcttaaggagctctgcctggcgctgggcgaagaatggggcccccgcggcggccccagcggcgccgggggatcaggagccgggccagcacccgagcttgccttgcccccgtgcgggccccgcgacctaggcgatggaagctccagcactggcagcgtgggcagtccggatcagttgcccctggcctgttcccccgatgattgaaggcactgcttcctccacgccgacgcccgcccggattgctccccgagccccgggaccgctgtggacctcgggacctggacgccgtcctggctgcgcaggaggggccgctggcatggactaagaaatcctgacaccaagaagggcccctcgctcttgctggcagggcagcagggggactgaaggctggagcggagggacttgctgggggttggattgggggtaataaacccggacggaagcgg

SEQ ID NO: 828 - DNA, 1540 bp, Homo sapiens
gtgcggcgcgcgtgggcaggtcattgcagttgggcgctcagcagctgtggcagccggttgaggtctggaagtagcgttgggctgaagcagcggagttcgccatgcgcgagtgtatctctatccacgtggggcaggcgggtgtccagatcggcaatgcctgctgggaactgtactgccttgaacatggaattcagcccgatggtcaaatgccaagtgataaaaccattggtggcggggacgactccttcaacacgttcttcagtgagactggagctggcaagcacgtgcccagagcagtgtttgtggacctggagcccactgtggtcgatgaagtgcgcacagggacctacaggcagctcttccacccagagcagctgatcaccgggaaggaagatgcagccagtaattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacagcaagaagtccaagctagagtttgccatttacccagccccccaggtctccacagccgtggtggagccctacaactccatcctaaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacggcctccctgcgatttgatggggccctgaatgtggacttgacggaattccagaccaacctcgtgccgtacccccgcatccacttccccctggccacctacgccccagtcatctcagctgagaaggcctaccacgagcagctgtctgtggccgagatcaccaatgcctgcttcgagccagccaatcagatggtcaagtgtgaccctcgccatggcaagtacatggcctgctgcatgttgtacaggggggacgtggtccccaaagacgtcaatgcggccatcgccaccatcaagaccaagcgcactatccagtttgtggattggtgcccgactggatttaaggtgggcattaactaccagccccccacagtggtccccgggggagacctggccaaggtgcagcgggccgtgtgcatgctgagcaacaccacggccattgcggaggcctgggcccgcctggtccataagttcgatctcatgtatgccaagtgggcctttgtgcactggtacgtgggcgaaggcatggaagagggagagttctctgaggcccgcgaggacctggcagctctagagaaggattgtgaagaggtgggcgtggattccgtggaagctgaggctgaagaaggcgaagcatactgaggggagggtgtggtgggttctcccctgccacccctaggatggctgctttcaagttgtttgcaattaaagattctgtataaaaccaa

SEQ ID NO: 829 - DNA, 3497 bp, Homo sapiens
gttttcctgctcccagcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcacgaactacatggtgcccagctgagcctgcggccagctccaccacgagcccctgcacgcctgctgctccaaggactgccccctggcaccacgccccagcgcttggagcagcatgtccaggccttgctgcgggcctcggggctcccagtacagccttgctgtgccttggccagcccccggccagaccgggctctggtccagttgcccaagcccctttctgaggcagatgtccgtgtcctggaggagcaggcccagaatctgggcctggaggggaccttggtgtccctggcccgggttccccaggcccgagcggtgcgtgtggtgggggatggtgcctctgtggacctgctgttgctggagttgtacctggagaatgagcgccgcagtggtggggggcccctggaggacctgcaacgcctacccgggcccctgggcactgttgcctccttccagcagtggcaagtggcagaacgagtgttgcagcaggagcaccggttgcagggctcagagctgagccttgtcccccactacgacatcctggagcccgaggagctggctgagaacaccagtggaggggaccacccgtccacccaggggcctagggctaccaagcatgctctcctgaggaccggagggttggtgacggctctgcagggtgcagggactgtgacaatgggctctggcgaggaaccagggcagtcaggggcctctctgaggacaggtcccatggtgcagggtagagggattatgacaacaggctctggccaggaaccagggcagtcagggacctctctgaggacaggtcccatggggtctctgggacaggcagagcaagtcagctcgatgcccatggggtctctggaacatgaggggctggtaagcctgaggcctgtggggttgcaggaacaggaggggcccatgagcctggggcctgtggggtctgcaggcccagtggagacctctaaggggttgctggggcaggagggcctggtggaaattgccatggactcaccagagcaagaggggctggtgggtcccatggagatcaccatggggtctctggagaaggcagggcctgtgagcccaggatgtgtgaagctggcagggcaggagggcctggtggagatggtgctattgatggagccaggggcgatgcgcttcctgcagctctaccatgaggaccttcttgcgggcctgggagacgtcgctctcttgccacttgaaggaccggatatgactggctttcggctctgtggagcccaggcttcctgccaggcggctgaggagtttctgcggagcctgctgggcagcattagctgccatgtgttgtgcctggagcacccgggcagcgccaggtttctcctgggcccagaagggcagcaccttctccaggggctggaggctcagttccagtgtgtctttgggacagagcgcctggccacagccacgttggacacaggccttgaagaggtggaccctaccgaggccctcccagtgctccctggcaacgcccacaccctgtggaccccagacagtacaggtggtgaccaggaggacgtgagcctggaggaggtccgagaactgctggccaccctggagggcctagacctagacggggaggactggctgcctcgggagctggaggaggaagggcctcaggagcagccagaggaggaggtgaccccagggcatgaggaggaggagcctgtggcccccagcactgtggcacccaggtggctggaggaggaggccgctctgcagctggccctccaccggtcactggagcctcaaggtcaggtggctgagcaggaggaggctgctgccctgcggcaagccctaaccctctccctgctggagcagcccccgttggaggcagaagagcccccagatggggggactgatggcaaggcccagctggtggtgcactcggcctttgagcaggatgtggaggagctggaccgggcgctcagggctgccttggaggtccacgtccaggaggagacggtggggccctggcgccgcacactgcctgcagagctgcgtgctcgcctggagcggtgccatggtgtgagtgttgccctgcgtggtgactgcaccatcctccgtggcttcggggcccaccctgcccgtgctgcccgccacttggtggcacttctggctggcccctgggatcagagtttggcctttcccttggcagcttcaggccctaccttggcggggcagacgctgaaggggccctggaacaacctggagcgtctggcagagaacaccggggagttccaggaggtggtgcgggccttctacgacaccctggacgctgcccgcagcagcatccgcgtcgttcgtgtggagcgcgtgtcgcacccgctgctgcagcagcagtatgagctgtaccgggagcgcctgctgcagcgatgcgagcggcgcccggtggagcaggtgctgtaccacggcacgacggcaccggcagtgcctgacatctgcgcccacggcttcaaccgcagcttctgcggccgcaacgccacggtctacgggaagggcgtgtatttcgccaggcgcgcctccctgtcggtgcaggaccgctactcgccccccaacgccgatggccataaggcggtgttcgtggcacgggtgctgactggcgactacgggcagggccgccgcggtctgcgggcgccccctctgcggggtcctggccacgtgctcctgcgctacgacagcgccgtggactgcatctgccagcccagcatcttcgtcatcttccacgacacccaggcgctgcccacccacctcatcacctgcgagcacgtgccccgcgcttcccccgacgacccctctgggctcccgggccgctccccagacacttaaccgaaggggccaccctctggcctcctgcttcccaggctcccagctccgcacaggctgatgctccccgcccccaactgtggccgcctgagctgtccccggggacgcccctgcctccctctgcgggctccagaaggcggtgtgggggatggcggtcagcagcggccgaggggggccgggctaggtcccagcctgggccgaccccaccaccaggggtcagcagagcccaggaggcgacaccgcccgcccgccgctcccagacctcgcccgagtcggctctgttgtttgaataaacgtgaacgtgaacccaggcggaagggacccggg

SEQ ID NO: 830 - DNA, 974 bp, Homo sapiens
agcgagtccgcgcgggcggtgccggggcggcggaggacggcttcaggcccaaaggggattgggcggcggctctaggtggcgggtcttggtttgcggaaggggctggagtcgctgcttctcggtgaccggcgcgtggcccggccaatcctgccgccgccacccacccgcaaccgcgtccgttgacggtcgggtccttggtcgccgggtccttgcgggcaccacagagcggggtggcgtccgctccctcgagtcctcggtgccagggaattcaccgctcaccaccccctgccccgccttgggtcctgctcggggaccaaaccactggaaggcagtggcgggaaacgggcgcctgtgccggagagttgagggaacatgagccatttgcagagcttattgttagacaccctcttgggaaccaagcatgtggacagtgcagccctcatcaaaatccaggagcggagcttgtgtgtagcatcaccaggtttcaatgtaacgcccagtgatgtccgaacactggtgaatggatttgccaagaaccctttgcaagcccgaagagaaggactgtatttcaagggaaaagattacagatgtgtccgggcagatgaatattctctttatgccaaaaatgagaacactggtgtggttgtcgtgaagacccatctgtatcttctggtagcaacttacactgagggcatgtatcctagcatctgtgtggaagccacagagagcctgggagactacctaagaaaaaaaggaagttaagtcatcagaggcccatgaaagacaattttattattttagaagaaaattgaagagcctaaagaaaaaatattttatggttgaaaaaacactagacagaaggcactaaaaaagaagaatgaattaagggagcaatttttattacttccagagatcctcttctttcactggaattacttgatcaactgttttttaataagtgttggtcatcggca

SEQ ID NO: 831 - DNA, 5549 bp, Homo sapiens
actcctgcacggcgagtgctggagcacgacgtaccgctcgctcggtcagggcgccccctccgcccgcctcctgcttcctcctccgctgcctgccgccgccgcctccaccattgtataatgctcggggcgcgcaggcagagaacggcggagtcttagcttcagcctcgcctgctgcccgctccccggcgccaccctcgggcccctggagcggggcactccgcatggagcgggagtagctgaggagtgggcggaaacccctcctgatgcgttagttcccaggtggagctgcatgtgatatatgttgggtaaaggaggaaaacggaagtttgatgagcatgaagatgggctggaaggcaaaatcgtgtctccctgtgacggtccatccaaggtgtcttacaccttacagcgccagactatcttcaacatttcccttatgaaactctataaccacaggcccctgacagagcccagcttgcaaaagaccgttttaattaacaacatgttgaggcggatccaggaggaactcaaacaggaaggcagcctgaggcccatgttcaccccctcctcccagcccaccaccgagcccagcgacagctaccgagaggccccgccggccttcagccacctggcgtccccgtcctcccacccctgcgacctcggaagcactacgcccctggaggcctgcctcaccccggcctcactgctcgaggacgacgatgacacgttttgcacctcccaggccatgcagcccacggctcccaccaaactgtcacctccagccctcttgccagaaaaggacagtttctcctctgccttggacgagatcgaggagctctgtcccacatctacctccacagaggcggccacggctgcgactgacagtgtgaaagggacctccagcgaggctggcacccagaaactcgacggtcctcaagagagccgcgcagatgactcaaaactgatggactctctgcctgggaattttgaaataacgacgtccacgggtttcctgacagacttgaccctggatgacatcctgtttgctgacattgatacgtccatgtatgattttgacccctgcacttcctcatcagggacagcctcaaaaatggcccctgtgtctgccgacgacctcctcaaaactctggctccttacagcagtcagcctgtcaccccaagtcagcctttcaaaatggacctcacagagctggaccacatcatggaggtgcttgttgggtcctaagacccagggacccagcgactatgcccacccagaccccagagcgttcccataaccctgacagttctccacactgtgcatgcacccttgcttgcctttttcagagaaaaagaaaattttacaacaggatcacactagtttttgctttgagcagagttggagtgccttcatccaagtatgaccacttttaatacacttttttgagtggttcctcagagacctactaccctggtataggaaagaatccatttgaagacaatgttgcaatgttgaatgacaaaaataaacagttcaagtgaagcacaaggattaagttggaaaagctgtaaattgcatgtgcatatttgtctattttttctataagttttattgcaagaggtaaagaagaaaactatatatatatatcttatttagataatctcagtaccttttctggcatttttgccctgtataggttgacttggcaattcggcctttttagaggcattaactactcctcgtaagtgttgcatttacatggctgtttagaaaactgctgcccaaatttattttatatttttgtacagattctgcagtttatgatattgtttttctaaaaacaaatgctgtttatacatatgagatagctattttgataggatttgctcacatagttcctgcaaacttcagatgtacaagttgcacttgtacttttatagagttgtaatgttttatatgtgtatggtgcaagagaaaattggatcaaatcaatctgcagttgatgtccccaaatgcaaacacaggcacacacatgcacacacccataaacacacacacagtgctttaagaaagggccaggtgatatcacacccaaatttcacaagcactgaccccctggcaccaacacccgccagtactgtgacttccaaagccagagccacatgtgctcatcaaacttgcattaagcagttggcgggagatggctgtggagctgggggtttaagtgatggttctcttttgctccctcttttgagggtaaagctactgtctttcttaagagtgtatttatgccaagtttgcgcttttaattgtttttattttgttttttaatgaaaacccagatctttcctttttggcataatttttatgatgacctgaaattttacatccgaacaaaattttacatccgaaaagcaaccaacttcttcatggaactcagccctgttgcaatgcttagggcccttaaagaagaaaatctccccagaaggcatccatcatgttgcttaattgtcttctgcagcttcctttccctagagctttccctgtgttgctaagagctgaaaatggcatcttcgtgatcaccacagtgagcttggctcgcctcggccggcccgggatgcactcttacaacatgtgtgactcttgaacctggagttcatcacattacgtcacagcttcccatctggttgctttcctgagtcagctacttcacacttgtcaaggctgttttaccccaaaactcagacaggactttctatgcatgttttccctcctccccccaattcccccccccatcaccttatctcccaggacacacttgagaagtagctttttattcctagtggtgtacatttaattttaaaaaggttgcaatgtatcatgcttgttgccgaaactgtttatggccttcttgtttcagttttttcttttcttccaatggtactttagctgttgagtgcaggttacaacctatattgttatgcagatggcttctttaggaataacttttatatttatttaaaaatttttaaattatgggatgttttgttgttgttgttgtctttgttgttggtcatttgtcaatattcagtcaccaattctgctcacttcttgccatggataaaattgggtctttctggctaattaaaaaagacaactttataaaatggcactttaagcaagccatagttagttttatttttgtaatgcacatggcaaagcaaagacgtttgtgatgaaggaactgctcatctaagcaaaagatttgagtatgatatgataaaggctttctacattctaatttactttttccccccacttgaatgtgttttaaaggctaattatcagctcagtagagcagtgagaaactgatcaaattgcacttgttctcctacaagcaacctccacgcagacacctcgtactgctacaggtgtgtcatttcctttaataggaccagggaccatgtaactgaggtgagggttgtagtagatgcttccagtgtcagtatgcctgttaattttaagagcttccctttcttgcagagaacaagtctgcccagattccatgctttctataactggaggacctggcaaacctgccgcatgctgcacacatctacctacgtacacatatacaatagtattgatgattctgaacaataacagggtaaaacagttggtttgccattgttaaaaactgatttacagtaacttacaacaactgtacttttgttggattagcaaatcatgtgtttaaacaaatcccatatgttgggcaacagttcaaataagcacggagaagtgttgcccaaacttggttctctgactcttatgtatttgtaaggctgggcttcaaaatcaaaacaaaaaccccaaaaacagcaggcaaatgctttttaactctgacaccgttgccataaatccctgatactcaaagtctaacaagaaagacatggaaaattagcagcccattttcagaaagatcaaaatgatctagggttctaattgcttttgcatcctattcttacaaagtgatgtcccaacagggaacagtaggagctggagtgggatctccaagtcccagtttgagtgtgggatgtgcttccagcagtgccttccctttatgaaagacatcacatggcatccagggccaggcaggcagcttgaggtgcctttacgagaaaaccgagctggggctgggagaggacagttattgacactgatgtgcaatgaagtgacaagatgagagcagaatcgtaagagctttgaatttgaagtgagtttttttccccccataagttatttattccttttttctgtgtaaatatatttattttactgtggagcgctaacatctggatcgtaacatgtgcagaatgtatggtaggaatgtattctcttgtaggaatgtaaatctgtattaaaagggggtccaagccaggcccccaggtcttctcattgtatgcacagtccgcattcatttttactcttctctaatatgggtctatttgaaatatgcaaaaggtatgaggaatgttttaatacctccaaatttttaagaaaagcatcaaagggttgatattttttaaagtttttttagtagcactttctctggatgacagaaggagcaaccacatgggcacccttgttcataccaaagggtgagcagtggccagagcctcctctgcacctctcgagtgtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgaaccacctttgtggtaaacaatgaattatgaataccgcagggcagccttcttaaatgacaaatgtaaaaaaaaaaaaaaaaaagactctacttcgtgcagcaattgctactctatacgaattgtcttaatttgaaaaccttgctgttacaaattggacctttatacattttctgaaaacaatgaaaagagtatatttaaccttttctggctgtaaatggttaccttcctgtaactgccccgcacctggaggcatggagttgtgtgcatcctgcttatgtacaattgttttcagtgtttctaagaatgagtctgaatggttcttgaaaattagccaggatcaaatgctattgcagacaaagccaataaaaagttggacttcttttggggataacaagttttggaagagaaatgcaggccatatgtgcgcatgaccgagattttgaaaaaagatgtacatagtgacatgtttggtgcatggtttttgaggagggcttttgtcaaaaaggaggtataacctttcccccacagacctgagagctgtgccttttctatgcaatattacagacgttacatcggaacccagatggctgtattcacatgtaggtttgggctgtaatctaaacaattggacagattaaatgtacatggaaatgagcagtcttacttttgtagttttatattatacaataaacagttaaaagatga

SEQ ID NO: 832 - DNA, 3257 bp, Homo sapiens
agagacccgagtgcacgtgtggagaagcggcggcacaagcgcggcggcgggagacactcccgcccccaccagactcaagccctcactcgactctcgcggccttcgttgctcgcacagctccctgcccaggctaggaggccggcttgcggggttgagtggcccgagctaagggtgcggagacctaagggcggcgactacgacggcgttgatatcggtggtaacgacggcctcagcaggcggggaagatgaaaggtagccggatcgagctgggagatgtgacaccacacaatattaaacagttgaaaagattgaatcaggtcatctttccagtcagctacaatgacaagttctacaagaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgattcctcccccaccccaacacttttcttttaaagcttttctccctccttgttcttgtttttctttcttcctttccttttctctgagagttttaatactttcaaggactttaaaaaaataatcatgtttgaattgttttctcttatttttgtgaggtggtttgaaggaaggacaaggtagatctgtttagttttgcagttgaagttagatggtcctaaacatttaattgtcaaataatttcaaatttaatgtcctgctttcacattgaagggcagagcctacaaaacattgtatatttcaaaagacaaaaagaagcagcagcagtatcttgttctctaattcatagacaagttgagtgtgtttgtggtactttgggtttttaaacactttgggatactaatccctagacattgccttcactccacctttagtccttctgagcactctctcgggagttggaacattgttatccttgtaagaaatactaagcttatgttgatttttaagtaattatatcttctcttcttgctggtgggtggggcagtttggtttagtgttatactttggtctaagtatttgagttaaactgcttttttgctaatgagtgggctggttgttagcaggtttgtttttcctgctgttgattgttactagtggcattaacttttagaatttgggctggtgagattaattttttttaatatcccagctagagatatggcctttaactgacctaaagaggtgtgttgtgatttaattttttcccgttcctttttcttcagtaaacccaacaatagtctaaccttaaaaattgagttgatgtccttataggtcactacccctaaataaacctgaagcaggtgttttctcttggacatactaaaaaatacctaaaaggaagcttagatgggctgtgacacaaaaaattcaattactgtcatctaatgccagctgttaaaagtgtggccactgagcatttgattttataggaaaaaatagtatttttgagaataacatagctgtgctattgcacatctgttggaggacatcccagatttgcttatactcagtgcctgtgatattgagtttaaggatttgaggcaggggtaattattaaacatattgcttctattcttggaaaaatagaagtgtaaaatgttaataatacaaatgtcactgtgacctcctccactgagaggactggtttatgccagatcattttccggcacacacggagtggctttgacagattgataactttgtaagatgggagacatctgaaatattcatgttttccttttgtagtcccatctccactatttagaaatgttctcagactttaaaataatgcacagggcttgagctttctgtcatttgactttaaaaggaagtttcattcatatttatcctcttatgtaaaattgcggtataaagtctcatttccaaatatgttaaatgacaaaattattttataaaatgtttatgcacactttataaccttaagtttttatttgagaatgtgaaagtacaaagtgcagtagacttcaacaatcttgagtgccaagaataatacagaaaaagaagacagttgatgaatgagtttatagggttctaatcttaagatggtaaaaatgtagaaagaccttgctggttttttgggggtattcgtttcttaaacaatccaaatctaagcttagaagaaaagtttagcgttaagcacctttatcttcatgaataagcttcagcttgctcttggcaagagaagagtgcttgagttacagaaggcataagtagtttgaagaatgcagcagcctttttgtaaacttcccagatatcaaaatagactttgatatataaatggttttctgagatgacactgcctctatttctataaccatttcacctggactatctaatcagtcctatgaatgtatccctaaatgtggttattgaaaacctaatagctgcctcatgacaagtacatgttatttaaggaggaaaaaatattaaattttgaattgagtgtgtaggctccctatcattatatatagagtttctttttccacggtagtcagtgacttaacctgaattgtaaatgtttgtaaagggttaattgtcctacatcaaacttagttaaataattccatccacttatggaggaggaggagaatgtggaagaggtaaaaagctgggcacaagttcatatgcctatgagtcagtaaagactgaagtaatgtcctatgttgagctggttattttgatatatgataataattatctttgaagtagaacaattctgttaactggaaaatcacaggatatatccatcatatttttcaggacagatagtttttactgtggggcaaataggttaaaattacactatgttagttgcatttaggttttaaagcaaagaatctgtagagaaatctatgcaatatatagtttgtccagattagctttcatttggggaatgaagttctgaaatatctaaagcagtttactcatcaattgaaaagtcctccaaaaagagaactattgggaaaccatggtgtggtggtggaaaagaaaagctccctcagttttttggagggaataacttaaaaaaatacttaaatggctaagtttacttggtgcagttaagaattaaacttgtcaattttaacattgctgttacatctgaaataaacttatgtgatgttctggt

SEQ ID NO: 833 - DNA, 3001 bp, Homo sapiens
gaccgggaggcgctgccgctctgggcagacggttccgggagccgcacggtcccctctccttccccatcctctcccctcccctctccgggttcccccacccacaggagccttgggccgaccactcccccgatggcctcagccacggaggaccccgttctggagcgttatttcaaaggccacaaagctgcgatcacctccttggacctcagccccaacggcaagcaacttgctactgcttcttgggatacctttctcatgctatggaatttcaagccacatgctagagcttacagatatgtgggtcacaaggatgttgtaaccagcgtgcagttttctccacatggaaacttattggcgtctgcctcacgagacagaaccgtgagactctggattcctgataagagaggaaaattctcagaatttaaagctcatacagctccagttcgaagtgtagacttttcagctgatggccagtttctagctacagcttctgaagacaaatccataaaagtatggagcatgtatcgccagcgcttcctgtattccttgtatcgacatacacactgggtacgctgtgccaaattttcacccgatggaagactaattgtgtcatgtagtgaggataaaactattaaaatttgggataccacaaataagcaatgtgttaataacttctcagattccgttggatttgcaaattttgtggactttaaccctagtggtacatgcatagcttcagcaggttctgatcaaactgtgaaagtctgggatgtaagagtgaacaaattactacagcattaccaagttcacagcggtggagttaattgcatatcattccatccttcgggtaactatctcatcacagcttcttcagatggtacccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagcaactctgtattttccccatattattttaaatgtccattttcatttataggccaaatcctgccaggaaagtaaccagatctctggatttcactgttaagtcatttcagattgaccatattcagacagtcatggggtgaaataattcacttacctccaaaatagcatcctatatgccaataatgagttattgatctgactagttgtatgtctttctgttcaaaatagaaattatcctttcttactaatgccttgaaagaatgaacaaataaaaattcccagaccacagaatttccacagcaagaatacacttattttaattaacaatagcacagatatagcatagggcagtgggttttttagttaatttatggcgtactttgtttatccattggccaacctgaaggaaatgaaactcacctatctttctatcacagatgaatgtgctagatgaatgatttgggttgtatctgatcatggttcacaaaaattatgttagtgtgttttcagtatgctaaaaagtcagagtgatacaaaagtgatatttaaaaatatacacacatgtatgtacacatgcttcagaaatattgttgcttagggtgatttgggcagctaaatagtaagtactttttaaaatttttgcatcatcatcttcctatttaatgaattgtgatttaaaacaaaatgaaaataagccaggtattctaaaagatcctggatacaaattaagaattttgctttattttaaaccaaattgagattaaattgaagaaaagcaagcaaattaatttcagcttgattatcaacctgtatcaagaacaaaaatgggaggaggtgtccacatttatggtgtgtataggtaacatggggaaaatgctattctgtgttttggaaaagaagaaatagtgccgtcctatttatttctatatttagaaatttttctcaaagaaatttcaattgtatctatgagatgggtttctaagtatcttattgtgtgttataagtgccttttaatatcatactaagtgtgagcttctggacattttcaagagcttacaaaaactaagtggcattgtatttttataaccccattgagaagactaagtaagaaatgaaatgtcctatcaattttattttgtcatgcttcaaacaataaagacatttctgctttaaaagaaaaa

SEQ ID NO: 834 - DNA, 1544 bp, Homo sapiens
cttgcgagaagacacgtgcgcggaaggagcttgcagtagcgggcggcagagctggagtgaagggagctagtgtttaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttg

SEQ ID NO: 835 - DNA, 3170 bp, Homo sapiens
gctaaccttgccgcgggccgagccctgcctcgccatggaccaggactatgagcggcgcctgcttcgccagatcgtcatccagaatgagaacacgatgccacgcgtcacagagatgcggcggaccctgacgcctgccagctccccagtgtcctcgcccagcaagcacggagaccgcttcatcccctccagagccggagccaactggagcgtgaacttccacaggattaacgagaatgagaagtctcccagtcagaaccggaaagccaaggacgccacctcagacaacggcaaagacggcctggcctactctgccctgctcaagaatgagctgctgggtgccggcatcgagaaggtgcaggacccgcagactgaggaccgcaggctgcagccctccacgcctgagaagaagggtctgttcacggtgacgcggctctgtgacctctcagtggaaggggactcagtgacctccgtgggctggtctgagcgggggaacctggtggcggtgggcacacacaagggcttcgtgcagatctgggacgcagccgcagggaagaagctgtccatgttggagggccacacggcacgcgtcggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaagctgctggtctggaatcactcgagcctgagccccgtgcagcagtacacggagcacctggcggccgtgaaggccatcgcctggtccccacatcagcacgggctgctggcctcggggggcggcacagctgaccgctgtatccgcttctggaacacgctgacaggacaaccactgcagtgtatcgacacgggctcccaagtgtgcaatctggcctggtccaagcacgccaacgagctggtgagcacgcacggctactcacagaaccagatccttgtctggaagtacccctccctgacccaggtggccaagctgaccgggcactcctaccgcgtgctgtacctggcaatgtcccctgatggggaggccatcgtcactggtgctggagacgagaccctgaggttctggaacgtctttagcaaaacccgttcgacaaaggagtctgtgtctgtgctcaacctcttcaccaggatccggtaaacctgccgggcaggaccgtgccacaccagctgtccagagtcggaggaccccagctcctcagcttgcatggactctgccttcccagcgcttgtcccccgaggaaggcggctgggcgggcggggagctgggcctggaggatcctggagtctcattaaatgcctgattgtgaaccatgtccaccagtatctggggtgggcacgtggtcggggaccctcagcagcaggggctctgtctcccttcccaaagggcgagaaccacattggacggtcccggctcagaccgtctgtactcagagcgacggatgccccctgggaccctcactgcctccgtctgttcatcacctgcccaccggagccgcatgctcttcctggaactgcccacgtctgcacagaacagaccaccagacgccagggctgattggtgggggcctgagaccccggttgcccattcatggctgcaccccaccatgtcaaacccaagaccagccccaaggccagaccaaggcatgtaggcctgggcaggtggctcggggccactggcggagccagcctgtggatccaagagacagtccccacctgggcttcacggcatccttgcagccacctctgctgtcactgctcgaagcagcagtctctctggaagcatctgtgtcatggccatcgcccggcggtcagtgggcttcagatgggcctgtgcatcctggccaagcgtcaccctcacactggaggaggatgtctgctctggacttatcaccccaggagaactgaacccggacctgctcactgccctggctggagaggagcacaacagatgccacgtcttcgtgcattcgccaacacgtgccctcacagggccagcgtcctccttccctgcgcaagacttgcgtcccccatgcctgctgggtggctgggtcctgtggaggccagcagcggtgtggcccccgcccccaggctgcctgtgtcttcacctgtcctgtccaccagcgccaacagccgtggggaagccaaggagacccaaggggtccaggaggtgggcgccctccatccttcgagaagcttcccaggctcctctgcttctctgtctcatgctcccaggctgcacagcaggcagggagggaggcaaggcaggggagtggggcctgagctgagcactgccccctcacccccccaccaccccttcccatttcatcggtggggacgtggagagggtggggcgggctggggttggagggtcccacccaccaccctgctgtgcttgggaacccccactccccactccccacatcccaacatcctggtgtctgtccccagtggggttggcgtgcatgtgtacatatgtatttgtgacttttctttggatttgttttgtgtttttgttgactagtcctggaaatgtttgaggctagacggggaggggccaggacccacccactgctcctgggggatgaggtcctggttttaaagccccgtcatttcaagcgggtcgatcttccacattcactggagagactctccccacctctgtctgggtggggcgcggacccctcactgtgcgcctgtgcagggggtgctggtgcacgtggcagtgtggatttccagtggtcacggtcttactgtttcaaggtttttaaataagaaaaccaaccctgccttcgcccatgcccgcccctgcccgcagttgccaaagagccgccttgtcgctgtgggcgtcagggcttggctggctcagtgcacaacccacagtggccttcagaggctcctcctgggactgggaaccgccgcagggccaggcggacggcgtgaggtttgtgttggggctggttctgcccatgctagggggtgggggagctcccaggacagaccagccttgtttctcatgtaatgcagtgacgctgtcattaaacacgtggattcatgtgtgg

SEQ ID NO: 836 - DNA, 6283 bp, Homo sapiens
aaagcgtcctgggtattgtagtgtattggagggaaggcgtcttggcgccttctcttcgcaccgttttccggagactgttagaggaagagtcgctttttcctgcctcccaggctgcccagcggcgccggttgccggggaacgcaggcgccgtggggagggatggcgggaggatactgcttaggtgctggagacggagttgagctggtgaagaagagctcgggctcatcatgaaacaacgaaaaggccaagggtctgggggcagccgtgggcgcaaaaaaagaggtttaagtgacatttctccatctacaagcctgccacctctggttgaaggccagctacgctgttttctaaaacttactgttaatagagtcatatggaagattgcaaagcctcccacttgtgtacttgtccgagtgagatggtggggagaaacatcagatggaaccctcttttgtcccagggatgcattgcagactgaaccaaaagctgtgagaacaactacacgttacgctattcgttgtggtccaaaacagtttacctcttatctaacagatatggctgtgctggtgctggaagtaatcaccaaacttgatggtcttccaattggtagagttcagatcaatggactagctcaactttctccaacccatcaaatcaatggattttttaccattgtttcatcaacgtctaagaaacttggagaactccaggtctcacttgccctggaacctctgtcagaaacttacgacagctaccatccacttcctaccactgacatgacagaaaatgtgcttttatctaagcagggattcagagagaatactgaacccagcagtacccagtttcaggttccatcaaggcctcgcgacatacataccatcaaaattgatggaaaagagttagcagccaacagcagtagatcaaccactccgaggggaaaagaccatgtatgctttgcagagaaccctgatacaataaaggattcttcctttggactacagcacagtcttaattcaggacagagtttagagtctgtaactctgaaaggcagagctccacggaagcagatgtcccttctgaacagttctgaattccagcctcaaattagaacagttgccaagagtcacagtgactcatgcattctttcttcaaacaacctccctaccaaggatcttctttcagctctgttagaacaaggcaataaactgcgtaatgccatggtgatttctgcaatgaaatcaagcccagagaccagcatgttgttggaccaagttcatcctcctattaatgaagattctcttagagcatcaacacagatcagagccttttctaggaatcggtttaaagaccacattgaagatcacctcctcccttcaactgagaatacattttggagacatgacacaaaagctgataccagagctatacagctgctattaggcagtgctgaattatcccaaggcaatttctgggatgggctaggctctcctccagattccccatctcctgggagtgatgtgtattgcatcagtgagctgaatgaccctcagtatgaccagagtcttctggagaatttattttatacagcacctaaatctgataccagcatcagtgatttcctcagtgaagaggatgatatcgtcccttctaaaaaaataagccagtcaacagctcttgccagatcatctaaggttctggagtcaagtgatcataagctgaagaagaggtcagcaggcaagagaaatagaaatttggttgaacaacagatgctctcagaaactccagaagatgcccaaacgatgacactaagtgtggatagactggcccttttgggtagaacacattcagtcagaatcatcatcgaaaccatgggagttcctccagatagtcctcagatgacccctggcaaaaaaagctatgctggtccaccacctaaggtgactacagcaaaaaagcgcactttctttgtagaatatcactttcctgtgggcttttcggaaagcggattgggaaagacagctttgatcactgaggttgttcgactcgcctccagtaaaattacagatggaaaggtgaagttccagcagcgatttgtgtttccagtacagtttggtggcccaatgatagagcactggtggaattccaacctcactttccaaatttatgtaaagaaaactccacagaaaaagccagaagtcattggatctgtgtcactttctttgcgagctgtcattcaatcagagctgctttctttcagtgatcagcttccagtgcaacaagaaaatggtcagtctccatttggccccctcaaggtaaccatggagcttattacagataacaaagatttcactggtatcaatactaagttaagtggcaacacccattataccccactttgtgctcctacaagtccaaataaggcactaccagaacttaaccaagatatgacctgtaccaaaaatccacaaaacttaaaccaaattcatgaggaaactgcaaagaaagcacagaacttggtgctccccaaccgaaagtcaccaagccctgtagcaccacatccttcaaccttcgtagctacgccagcctcccataatttagtcaatcagacaaatgggacaacaaaagagagtgctttgctgttgcatgtgctgttgatggtgccagatgggaaagattttattagtggagaatctgagaaacaatcaccatgcaatgtttatttaaattgtaaactcttcagcacagaggaagtcaccagatctgtcatcgcatggggcacaacacaaccggtctttaacttttctcaggtgattcctgtctctctgtcttccaaatacctggaaaggcttaagaacaatgtgatggtaattgaaacttggaataaggtgcggagcccaggacaggacaagctgctcgggctggtgaaacttcccctccaccagttttacatgtcattcaaagatgctaagatttctcgcctgctgctggatgcccagtacccagttgttgctgtcgacagctacatgcctgtgattgatgtgttttcaggccaccaaaatgggagtcttcgagtctttttagctatgggttcttcaaatcaaataatggcactacaaagattaaagaatgaagaaggaacactccctcccttcagccctaggccagcccatttcctggaccagccaactgcagcatctgttgctatggcagaggaccgaggaaatggactgatggagcactgctttgagatccatatagagatggttaaagggctagcccctcttcaggcaacagtctggggagaagcagattgttatgtccagtactactttccagttcaacactctcaatccagtgtgctgaaaggacctgagttccttgaaaatggaattactctgaagcccttcagaactgcaaccacactctgtgttccagatcccatctttaatagtgaacaccatcactctctcctgttgccagctgaggttccagtgcaaaggctcctactaagtgctttctctgcacagggcctcgtgcctggaggtggagtccagtttgaaatctggtgcagatactattatcctaatgtgagagaccagaaggtcgccaaaggaaccttgccattatcaaggatctgtgctatggtaaccacccagcatcgtgaggatgtgggaatacagacctttaatctccctttaacccccaggattgagaacaggaaagaattgaggaaccagtcatcaggtttactggatgtgggcctaaggtacaggcgtagtccaagaacagcagagggagttcttgctgcccgaactgtttccatctcagtccagattatcagagcctgtggtctgcaagcagcagccaaggctttggctgaacgggaacccgctctacagtttagtgccacagtcggggtcaatgcctctgtcaccactcatctctccttcctgccccagggagaacagcgccgaacccaccctgtggcctgttctttctgccctgagttctcccatcacgttgagttcacatgtaacttggtgactcagcactgtagtggagaggcctgtttcctagcagagttgttggagtttgcagaagttatttttgctgtctatcatgaaaataccaagtcagcaagtgatataatcagtattgagtcatgcaaagagtatctgcttggagtagtaaaagttccaacaaaagagctgctgatcaagagatctgggatcacaggatggtatcctatcattttaccagaagacgggggcctacctcatggcctggagctcatgcagaagatcgtgggtggtctggagctttcgatttccttcacgcatcgtggagatagagaacgggtgttggaagctgctgagcatttgggctggagctttgagaacagcctgaaagattttgtcagaatggatgaaggggagccagccactgtcaccatctccaccccaaggctgtggctgcccatccattgtgtgctgcttgctggccacaaccacattcataagaatacatattgctaccttcgctacaagttctatgatcatgaagccttttggacccctctcaagaagcctaaggaatctgtaaacaaaaagcagattatggtcactttcaaggcatccaaaagagcagaagtcaccaggggcccatcactgctttggtacttcagggaggagaggctagagatccaagtgtggcgagcttatggcaatgacagtgtggagagaccccatcagacagacagctggattggctcagcctatgtggacctggccagacttggggagaggtcagcgaggacgctaactgtcagtggtgtgtatcctctgtttggacgaaatgcttccaacctctcaggagctgccttgcgagttcatgtggttctttcctctctttcctcacaccttgagcccactcatgagctggactccatggactgcagcagccacagtgagtctgagcagctccccagaaggaatgatgaggtccagctctctccaccagaagtcatctcctgccaccagaagtctcctgcctccacccaggtcccctgcagcagcaccacagctgaagtccgcctgacgcaggagggccctgctgatttggatggaacgtttgcagtcagcatcctagtagaaagagcaatgcacttgagcttgaaagggagccccttgacagagcggaaagtatcgatacccagttgttgtgtatcctttgcaacagccgatgagtcatctcctgtatacacccaagtggttgaaaacacagattcccccatctggaattttcaacagcagtcaaggctatcaaaagagctgcttctggacccacaacaaaccctggtcttcaaagtttggcataaaggagatgaggagagggtgattggctttgcctcggtggacctctccccacttctctctggcttccagtttgtctgtggctggtacaacatcacagacttcagtggagagtgccaggggcagataaaagttgctgtctcccctttggagagtttgatacacttcaaagaagaaaggcaagcaaggcgtggagtggagacctcaaaatcactgatcccaatatacagtcccttttccttccctgcctctgatacgtatgctgcattctccagccacatggcaaggcagaccctagaccaacttgctcatgcctcctcaaaggagcttgatttctcctctcctgggagaagtgataccacaagaagccaagcatcacgccatgaagagcatgtgcagaacattcgccggtttcatgaatccctgcatcttcagggagaggcacccttgccatgtgatgacaaactgaccacatcacctttgtcctcccaaacctccattctgacttctctcaggaagaatctgagtgagcttgatcagattcagaggtacttccgccagaagctcaccaagcctttcctacccctcagccctcagactcaaacggccatctcacagcaccaggagagctgtagggaccatcttgggccaggtgccagcagcctagaccctgggagccagtgtatcctggagaaatccagtaacctggtgttgcaagtcagctccttaatcacaggtagttactgaagtaactggaagcatgaacatgcccaccaggactcccagctcccaacgattcctgagcatgagcagatagtctctgaaagcatttccacagatgtatccacaactatagattagattctggtcctctgatattagaataaagtactaaaaattgtaccgccttg

SEQ ID NO: 837 - DNA, 6225 bp, Homo sapiens
aaagcgtcctgggtattgtagtgtattggagggaaggcgtcttggcgccttctcttcgcaccgttttccggagactgttagaggaagagtcgctttttcctgcctcccaggctgcccagcggcgccggttgccggggaacgcaggcgccgtggggagggatggcgggaggatactgcttaggtgctggagacggagttgagctggtgaagaagagctcgggctcatcatgaaacaacgaaaaggccaagggtctgggggcagccgtgggcgcaaaaaaagaggtttaagtgacatttctccatctacaagcctgccacctctggttgaaggccagctacgctgttttctaaaacttactgttaatagagtcatatggaagattgcaaagcctcccacttgtgtacttgtccgagtgagatggtggggagaaacatcagatggaaccctcttttgtcccagggatgcattgcagactgaaccaaaagctgtgagaacaactacacgttacgctattcgttgtggtccaaaacagtttacctcttatctaacagatatggctgtgctggtgctggaagtaatcaccaaacttgatggtcttccaattggtagagttcagatcaatggactagctcaactttctccaacccatcaaatcaatggattttttaccattgtttcatcaacgtctaagaaacttggagaactccaggtctcacttgccctggaacctctgtcagaaacttacgacagctaccatccacttcctaccactgacatgacagaaaatgtgcttttatctaagcagggattcagagagaatactgaacccagcagtacccagtttcaggttccatcaaggcctcgcgacatacataccatcaaaattgatggaaaagagttagcagccaacagcagtagatcaaccactccgaggggaaaagaccatgtatgctttgcagagaaccctgatacaataaaggattcttcctttggactacagcacagtcttaattcaggacagagtttagagtctgtaactctgaaaggcagagctccacggaagcagatgtcccttctgaacagttctgaattccagcctcaaattagaacagttgccaagagtcacagtgactcatgcattctttcttcaaacaacctccctaccaaggatcttctttcagctctgttagaacaaggcaataaactgcgtaatgccatggtgatttctgcaatgaaatcaagcccagagaccagcatgttgttggaccaagttcatcctcctattaatgaagattctcttagagcatcaacacagatcagagccttttctaggaatcggtttaaagaccacattgaagatcacctcctcccttcaactgagaatacattttggagacatgacacaaaagctgataccagagctatacagctgctattaggcagtgctgaattatcccaaggcaatttctgggatgggctaggctctcctccagattccccatctcctgggagtgatgtgtattgcatcagtgagctgaatgaccctcagtatgaccagagtcttctggagaatttattttatacagcacctaaatctgataccagcatcagtgatttcctcagtgaagaggatgatatcgtcccttctaaaaaaataagccagtcaacagctcttgccagatcatctaaggttctggagtcaagtgatcataagctgaagaagaggtcagcaggcaagagaaatagaaatttggttgaacaacagatgctctcagaaactccagaagatgcccaaacgatgacactaagtgtggatagactggcccttttgggtagaacacattcagtcagaatcatcatcgaaaccatgggagttcctccagatagtcctcagatgacccctggcaaaaaaagctatgctggtccaccacctaaggtgactacagcaaaaaagcgcactttctttgtagaatatcactttcctgtgggcttttcggaaagcggattgggaaagacagctttgatcactgaggttgttcgactcgcctccagtaaaattacagatggaaaggtgaagttccagcagcgatttgtgtttccagtacagtttggtggcccaatgatagagcactggtggaattccaacctcactttccaaatttatgtaaagaaaactccacagaaaaagccagaagtcattggatctgtgtcactttctttgcgagctgtcattcaatcagagctgctttctttcagtgatcagcttccagtgcaacaagaaaatggtcagtctccatttggccccctcaaggtaaccatggagcttattacagataacaaagatttcactggtatcaatactaagttaagtggcaacacccattataccccactttgtgctcctacaagtccaaataaggcactaccagaacttaaccaagatatgacctgtaccaaaaatccacaaaacttaaaccaaattcatgaggaaactgcaaagaaagcacagaacttggtgctccccaaccgaaagtcaccaagccctgtagcaccacatccttcaaccttcgtagctacgccagcctcccataatttagtcaatcagacaaatgggacaacaaaagagagtgctttgctgttgcatgtgctgttgatggtgccagatgggaaagattttattagtggagaatctgagaaacaatcaccatgcaatgtttatttaaattgtaaactcttcagcacagaggaagtcaccagatctgtcatcgcatggggcacaacacaaccggtctttaacttttctcaggtgattcctgtctctctgtcttccaaatacctggaaaggcttaagaacaatgtgatggtaattgaaacttggaataaggtgcggagcccaggacaggacaagctgctcgggctggtgaaacttcccctccaccagttttacatgtcattcaaagatgctaagatttctcgcctgctgctggatgcccagtacccagttgttgctgtcgacagctacatgcctgtgattgatgtgttttcaggccaccaaaatgggagtcttcgagtctttttagctatgggttcttcaaatcaaataatggcactacaaagattaaagaatgaagaaggaacactccctcccttcagccctaggccagcccatttcctggaccagccaactgcagcatctgttgctatggcagaggaccgaggaaatggactgatggagcactgctttgagatccatatagagatggttaaagggctagcccctcttcaggcaacagtctggggagaagcagattgttatgtccagtactactttccagttcaacactctcaatccagtgtgctgaaaggacctgagttccttgaaaatggaattactctgaagcccttcagaactgcaaccacactctgtgttccagatcccatctttaatagtgaacaccatcactctctcctgttgccagctgaggttccagtgcaaaggctcctactaagtgctttctctgcacagggcctcgtgcctggaggtggagtccagtttgaaatctggtgcagatactattatcctaatgtgagagaccagaaggtcgccaaaggaaccttgccattatcaaggatctgtgctatggtaaccacccagcatcgtgaggatgtgggaatacagacctttaatctccctttaacccccaggattgagaacaggaaagaattgaggaaccagtcatcaggtttactggatgtgggcctaaggtacaggcgtagtccaagaacagcagagggagttcttgctgcccgaactgtttccatctcagtccagattatcagagcctgtggtctgcaagcagcagccaaggctttggctgaacgggaacccgctctacagtttagtgccacagtcggggtcaatgcctctgtcaccactcatctctccttcctgccccagggagaacagcgccgaacccaccctgtggcctgttctttctgccctgagttctcccatcacgttgagttcacatgtaacttggtgactcagcactgtagtggagaggcctgtttcctagcagagttgttggagtttgcagaagttatttttgctgtctatcatgaaaataccaagtcagcaagtgatataatcagtattgagtcatgcaaagagtatctgcttggagtagtaaaagttccaacaaaagagctgctgatcaagagatctgggatcacaggatggtatcctatcattttaccagaagacgggggcctacctcatggcctggagctcatgcagaagatcgtgggtggtctggagcatttgggctggagctttgagaacagcctgaaagattttgtcagaatggatgaaggggagccagccactgtcaccatctccaccccaaggctgtggctgcccatccattgtgtgctgcttgctggccacaaccacattcataagaatacatattgctaccttcgctacaagttctatgatcatgaagccttttggacccctctcaagaagcctaaggaatctgtaaacaaaaagcagattatggtcactttcaaggcatccaaaagagcagaagtcaccaggggcccatcactgctttggtacttcagggaggagaggctagagatccaagtgtggcgagcttatggcaatgacagtgtggagagaccccatcagacagacagctggattggctcagcctatgtggacctggccagacttggggagaggtcagcgaggacgctaactgtcagtggtgtgtatcctctgtttggacgaaatgcttccaacctctcaggagctgccttgcgagttcatgtggttctttcctctctttcctcacaccttgagcccactcatgagctggactccatggactgcagcagccacagtgagtctgagcagctccccagaaggaatgatgaggtccagctctctccaccagaagtcatctcctgccaccagaagtctcctgcctccacccaggtcccctgcagcagcaccacagctgaagtccgcctgacgcaggagggccctgctgatttggatggaacgtttgcagtcagcatcctagtagaaagagcaatgcacttgagcttgaaagggagccccttgacagagcggaaagtatcgatacccagttgttgtgtatcctttgcaacagccgatgagtcatctcctgtatacacccaagtggttgaaaacacagattcccccatctggaattttcaacagcagtcaaggctatcaaaagagctgcttctggacccacaacaaaccctggtcttcaaagtttggcataaaggagatgaggagagggtgattggctttgcctcggtggacctctccccacttctctctggcttccagtttgtctgtggctggtacaacatcacagacttcagtggagagtgccaggggcagataaaagttgctgtctcccctttggagagtttgatacacttcaaagaagaaaggcaagcaaggcgtggagtggagacctcaaaatcactgatcccaatatacagtcccttttccttccctgcctctgatacgtatgctgcattctccagccacatggcaaggcagaccctagaccaacttgctcatgcctcctcaaaggagcttgatttctcctctcctgggagaagtgataccacaagaagccaagcatcacgccatgaagagcatgtgcagaacattcgccggtttcatgaatccctgcatcttcagggagaggcacccttgccatgtgatgacaaactgaccacatcacctttgtcctcccaaacctccattctgacttctctcaggaagaatctgagtgagcttgatcagattcagaggtacttccgccagaagctcaccaagcctttcctacccctcagccctcagactcaaacggccatctcacagcaccaggagagctgtagggaccatcttgggccaggtgccagcagcctagaccctgggagccagtgtatcctggagaaatccagtaacctggtgttgcaagtcagctccttaatcacaggtagttactgaagtaactggaagcatgaacatgcccaccaggactcccagctcccaacgattcctgagcatgagcagatagtctctgaaagcatttccacagatgtatccacaactatagattagattctggtcctctgatattagaataaagtactaaaaattgtaccgcctt

SEQ ID NO: 838 - DNA, 1968 bp, Homo sapiens
attgtcgctttcgctacccgcggggccgggcgagcgggaagctcggcacagtgggagcctggtggtgggtctcctggggccggtcgcaatgggtttccgggggtcccgcggctgctctgtggaccccttcggcccctggtgctccgggcgctggcagcgtcaccggacaaaggccaccgagcgcgggggtgtccccgaggtggacgcgcgggtttacttcctctccggccccacgggcgcgcttccctcctgacggattccgaagcccgccccaccaccgtcaccgcaccagtggcccaggcttcgtgggaccaacagggctaatcctgccccacggatctaatccggatcgggacccggtcccaggggaggcccccacctccccttctattgttctgtggcccaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacggggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctatgaccccaacctggacaactgtctggtgactgaggatctcctctctgtgctggctgagctgcaagaggctctatggcattggcccgaggacagccacccaggcctggctggggcctcagatactggtacaggcggctgcctggttgtacatgttgttagctgtgaggaggagttccagcaacagaagttggacctgctttggcagaagttggttgacaaggctccactcagacagaagcacctcatctgtggccctgtgaaagtagctggtgcacctggcactctgatgactgcccctgagtactacgagttccggcatacccaggtgtgcaaggcctcagcactgaagcatggtggggatctggcacaagacccagcctggacagagatctttggtgttctctctgtggccaccatcaagtttgagatgctgagcacagccccacagagtcagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgagggtgagtggttgttgctcttcaacagtatcctcccctttccggatctgctgagccggacagcagtgctggactgcacagccccggggctccacattgctgtacgcacagagatgatatgcaagttcctggtacagctcagcatggatttcagctcctactacaaccgggtacacatcctgggggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgtt

SEQ ID NO: 839 - DNA, 2151 bp, Homo sapiens
gtgtttcaccacacggagatgtggtcacgtgacttgtcaactttcacccaggatgtctcccttctgacttccccttagcaaccaagtcgcggcgcttggttccccagcaaccgggagacgcgtctgctgcgtggaaccgccgagttcccagcgcttgagaagggtcttcctatgttgcccgggctggtcttgaactcctgaactcaagcagtccttccacctcggcctcccaaagagctgggattacaggtgaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacaaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggagactataaacatgtttgaaaggaacattgttgacatggtaggactgtttatcgaaaatgtccaaagcctgatggctcagtgccgggacctggagaatcaccaccacgagaagctcctggagatctctatcagcaccctggagaagattgtcgagggcgacctggacgaggacctgcctaacgacctgcgcgcgctttttgtcgataaagatacgattgttaatgctgtcggggcatcgcacgacatccacctcctgaagattgacaatcgagaagatgagctggtgaccagaatcaactcttggtgtacacgtttaatagacaggattcacaaggatgagatcatgaggaaccgcaagcgcgtgaaggagatcaatcagtacatcgaccacatgcagagcgaactggacaacctggaatgtggcgacatcctagactagatgaatgtcagccacaggagcttcttcaaaacatagcaccagccccagccaggagaaggaagtgcacacgcctcacccgcacctctagagagttgctgggcatctctcaaccgcgatccccaacaccattcttcccccacccctggaaaaacttccaaaagtagagaaaataaaggactcatttcacatttcccctactc

SEQ ID NO: 840 - DNA, 2292 bp, Homo sapiens
ggcctgcggcgcgcgggaagcggcgcgcgctgcgcgggaggtgacggtgcctctgactgtccgggtccctccagcattttgcagctttctcctgtcttgaagaagtagaacggtgcccgagaaacgtttttccccttcgagactcaggaggatgaaagtcatcacttgtgaaatagcctggcacaacaaggagcccgtgtacagcctggacttccagcatgggacggctgggaggatccacagactggcgtctgccggcgtggacaccaatgtcaggatctggaaggtagaaaagggaccagatggaaaagccatcgtggaatttttgtccaatcttgctcgtcataccaaagccgtcaatgttgtgcgtttttctccaactggggaaattttagcatcgggaggagatgatgctgtcatcctattgtggaaggtgaatgataacaaggagccggagcagatcgcttttcaggatgaggacgaggcccagctgaacaaggagaactggacggttgtgaagactctgcggggccacttagaagatgtgtatgatatttgctgggcaactgatgggaatttaatggcttctgcctctgtggataacacagccatcatatgggatgtcagcaaaggacaaaagatatcaatttttaatgaacataaaagttatgtccaaggagtaacctgggaccctttgggtcaatatgttgctactctgagctgtgacagggtgctgcgagtatacagtatacagaagaagcgtgtggctttcaatgtttcgaagatgctgtctggaataggggctgaaggagaggcaagaagctaccggatgtttcacgacgacagcatgaagtctttcttccgtagactgagtttcactcccgacggatctttgcttctcacgccagctggatgtgtggaatctggtgaaaatgtaatgaataccacttatgttttctccaggaagaatcttaaaaggcccatcgctcatcttccatgtcctggaaaagccactcttgctgttcgctgctgtccggtctactttgaactgaggccagtggtggaaacaggtgtggagctgatgagtctgccctaccgcctggtgtttgctgtggcctcggaggattccgtgcttctgtatgacacccagcagtccttcccttttggttacgtgtctaatatacattaccacaccctcagtgacatttcatggtccagcgatggtgccttcctggccatttcttccacggacggttactgctcatttgtgacatttgagaaagatgaacttggaattcctttgaaagagaagccagttttgaacatgagaactcctgatacagcaaagaaaaccaagagtcagacacatcgagggtcttcgccaggacccagaccggtagagggaacccctgccagcagaacccaagaccccagcagccccggcacgactccccctcaggccagacaggccccagccccaacagtcatcagggaccctccctccatcactcctgctgtcaaaagccccttgccggggccttcggaggagaagaccctgcagcccagtagtcaaaacacaaaagcccacccatcccggagggtcactctgaacacactgcaagcctggagcaagacaacaccccggagaataaacttaacacccttaaagacggacactccaccaagttctgtaccaaccagtgtgatttccaccccttctacagaagaaattcagtcagagacgcctggagacgctcagggcagtcccccagagctaaagcggcccagactcgatgaaaacaaaggaggcacggaaagtctggacccttgatgggacctcggcttctgctcgaagcctaccaggctcccggtgtgtgcagggagacggtaaagctggaggtgcctgagaccagggcttccatggagcgggacacactgtaaatggatttctataacagaagtgacatgtgtactgatttttctccagaaatatggatgctgttgtattcagtatccatttttaacttgggacatgaacgttttaacgtagtaaatcctctttttgatgagtttctgaaactggagcggttcaacgttatccagtgtgaaaatcagtgagtcctccctggcatcctcgtgaaagtgcacacacttcatggagggactccttttcaataagaattaggaagatgagaaagtaatttgagattttactctgtcgaattttagagtatttgaagtgattgttagatttcacttctaaggagttgattgattaaactttggaaggta

SEQ ID NO: 841 - DNA, 1853 bp, Homo sapiens
ccccccgcccacccgggcccggacacgctgagcacactggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctgctcaaggtccgctcccagttccgacagatcttcctggagatggggttcaccgagatgccgactgataacttcattgagagctccttctggaactttgacgccctcttccagccccagcagcacccagcccgtgaccagcacgacaccttcttccttcgagatccagcggaggccctgcagctcccaatggactatgtccagcgggtcaagcggacccactctcagggcggctacggctcacaggggtacaagtataactggaagctggacgaggcccggaaaaacctactgcgaacccacaccacatcagccagcgcccgtgcgctctaccgccttgcccagaagaagcccttcactccggtcaagtacttctccatcgaccgcgtattccggaatgagaccctggacgccacgcacctggctgagttccaccagatcgagggcgtggtggcggatcatggtctcaccttgggccacctcatgggcgttctgcgggagttcttcaccaagctgggtatcacgcaactccgcttcaagccagcctacaacccatacacagagcccagcatggaggtgttcagctaccaccaaggcctgaagaagtgggtggaggtcggaaactcgggggtcttccgtccagagatgctgctgcccatggggcttcccgagaacgtgtcggtcattgcctggggcctctccctggagcgcccaacgatgatcaaatatggcatcaacaatatccgggagctggtgggccacaaggtgaacctgcagatggtgtatgacagtcccctgtgccgcctggatgccgagccgaggccccctcccacacaggaggctgcgtgacatgggccactctaggacaggtcatcctccccgagtccctgctgctgcgctcctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgcccccatctggtggc

SEQ ID NO: 842 - DNA, 2254 bp, Homo sapiens
gacaacaagatggcggcgctgcgggacggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgaagatgaggtggacatgttgagtgatgggtgtggctcagaagaaaagatctcagtcccttcctgctatggcggcataggtgcccctgtgagtcggcaaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagctgatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggccccagtcccggtcccggtcccggccccagtccctgtcctggacccagtcccagcccccaataaagcacccgccccctcaacccgctgctccgccaggctcttgggtgggccatctcgccaggcacgtaggaaaggcctgggaccagctgggccagggagggggcggtgccgacccgccccttggtaactcgagccccggctggcgggcctggctgctgggtctttgtcttctaggttcctctttctcccaagaagggctaagtggatcctgtgaagggagggatgcagtggggggaaggagctggccccagctgggtttacattctcagctgggacagcagagcctcactgtgtatgtgtgcagccagcagatacctgtgcacaggcacagacccaccaactcgtggggacacttcaacaccgcacaaagccattttgccactagacccatgcccccaaattagcagaactgcagctgggtacccacctcccatgatacactcattcttagccattgtgctccaacacaggcgcatgggatggccacactcactgacaggcatggagatgtgcactacacaccaaggcacaagcatgatatggacacatgcatgtgaactggagggtggcccacccagacatctccagaaaccactggtccatacaggtatttgtgtgtcagacatatccaaacacatgcactaacaaacacagaggtgacagtcacaagagaacagctcagccacccttcccacagagcagtctcagcacagtcacaactaccaaccttgcccagggcagggacccaggaggcccaggccacaaccaaccagacacagtgccaatggaacaggacatcatttaattgcctctagggtcctcctgggagagggactgcggggcctttggcagagctctggctgatggaaccaacagaggtgcccatcagccagtgccaggcaggatggcggccccaatgcttggctgggggcagccagcatttggggctgttgcttaagacaatttctgagact

SEQ ID NO: 843 - DNA, 1536 bp, Homo sapiens
gacacaggaaactcccctgaaacctgtttctcagcttcccggcccagctggggcacccactggaaggagaggccaggcggaagaccctggctccgtcatggcctctgccctgaggccaccccgtgtccccaagcctaagggtgtcctgccttcacactactatgagagctttctagagaagaaggggccctgtgaccgggattacaagaagttctgggcaggcctgcagggtctcaccatttatttctacaatagcaatcgggacttccagcacgtggagaagctcaacttgggagcatttgagaaactcacagatgagattccctggggaagctcacgtgaccctggcacccacttcagcctgattctccgggatcaggagatcaagttcaaggtagagaccttggagtgtcgggaaatgtggaaaggcttcatcttaacggtggtggagctccgtgtcccgaccgacttgaccctgcttcctgggcacctatacatgatgtctgaagtcttggccaaagaggaggcgcgccgtgcactggagacaccctcgtgcttcctgaaggtgagccggctggaggcacaactgctcctggagcgctaccccgagtgcgggaacctgctgctgcggcccagcggggacggcgccgacggcgtgtcggtcaccacgcggcagatgcacaacgggacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatgtggcttcctctagttggccagtcatcctgaagccaaagaagttgccaaagcctcctgccaagcttccaaagccacccgttggacccaagccagtagagaaggggtttcaccatgttgcccaggctggtctcgaactcctgacctcaagtgatccacccacctcagcctcccaaagtgctgggattaccggcgtgagccaccacacctggcctcatctgtcttctcttccagagcccaaagtctttaatggtggcttgggcaggaagctgccagtcagttcagcccagcctctcttccccacagccgggctggcagacatgacggcagagctacagaagaagctggagaagaggcgggcactggagcactgattcggacacaccagggaccagcgggctagtcccagggcatggcccagcggccagattctttttcccaggattaaaactctgaccccagg

SEQ ID NO: 844 - DNA, 2919 bp, Homo sapiens
gagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatcaaaaacaaatagttcatcaaatgatttggaagttgaagatcgtacttcgttggttttaaattcagacacatgctttgagaatttaacagatccctcttcacctacgatttcttcttatgagaatctgctcagaacacctacacctccggaagtaactaaaattccagaagatattctccagcttttatcaaaatacaactcaaacctagctactccaatagcaattaaagcagtgccacccagtaaaaggttccttaaacatggacagaacatccgagatgtcagcaacaaagaaaactgaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggattattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaaagagggagatttccaggcctgggtaactatatactgtgaccattggaggtagagacaggtctcaacagttggaaccaggaactctgctgtcaggttgagagttttgtttctcttccagcttttcactgtgtgggggtcttttctcttatgtcagctctttctatcacatggcagctgacctctcacgctccactctgcagcttggacacccagtagaccctgaatttcactctctctaaaaggttctgagggctcatcctgggccaggggccctcctgtgcactgttagctatggccacgggagcctccagagctgcctggtagcttcaggttgacctgcttatcaggcctacgatccttctgatttaagtacagctggaaagtattatctaattaagttcatgatagtgcttttggagaacttgtcaaattacagccaatgagaaaataaggacctagcatactgtggagaaccattaaaaatttgagaagaaacaacaagtattatgtcaacttacttcaaaggcgtagttttgggaatttgatgcagtaaagattaccctgttttatgattgttccttgaaagtcaaatgggggacctgtccattgtgctctattaatcttgtcagaaaactgtcaccaaaacaaaacttgagtttgtccttgttctaggagttactgggtagttgtaagtattatttttattaaatataatgtaaaataaaatgttaagatacttagttttgtttttcaaagtaaagctgtagtcagccttatgtatgccattgactctgaaatgtataccagcctttcactgtgtaccgtgtgtatataaatccacagaaccggatgagctgcttagggagggaatatattcaaagtgtaccaaggaccaaatcctggagttctcccaactttagaggatggaaaggggcagagtaatctagcaaaggagactgaggccagtgaagtaggaagaaagtatttcaaggagagtgatgattctgtgaatattgctgagaattcaaataaaaagaggactgagaactga

SEQ ID NO: 845 - DNA, 3124 bp, Homo sapiens
ggaagcgagtaagagaaaggggaaggggaggtgggagaggcacctcaactttgatgtcccgagccttgagtggccactcgcaagctggccaagggcttcacacaatttgccaagatgacagaggggaccaagaagaccagcaaaaagttcaagttcttcaagttcaagggctttgggagtctctccaacctccctcggtccttcactctgagacgatcctcagcttccatcagtaggcagtcccatttggagcctgacacctttgaagccacgcaggatgacatggtgacggtgcccaagagtcccccagcctatgcccgctccagtgacatgtacagccacatgggcaccatgcctcgccccagcatcaagaaagcacagaactcacaggctgcccggcaggcccaggaggcgggtcccaagcccaacttggtacccggaggtgtacccgaccccccaggcttggaggcagccaaagaggtgatggtgaaggccactggccctctagaggacaccccagcaatggaacccaacccttcagcagtggaggtagaccccatcagaaagcctgaggtccccacaggagacgtagaagaggagagacctcccagggacgtgcactcagaaagggctgctggagagccagaggctggcagcgactatgtgaagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggcccagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctggggttccctgttttcgagccatgggaggcaggctgctcacgcctcctcactctctgtctgtccctcaccaacaccaaggcctccatctcactgtaaataagtctctgttctgtaaatagatgtacagaagccatgttatttctttcatataataaacttttatgactctt

SEQ ID NO: 846 - DNA, 850 bp, Homo sapiens
gcgcctcggcccgggccttactctccaccgactgcgtcaggatgagctccaggttttctttgggccgatgcttcgtgtcctccaccagcttatagacgcgatgtcgccggtgcaggcgcggcttccggccctccccggccagcggtaccttccaccagcgctccacgatgaccgtgccctggcggccaggaaagcgacgcatcacttataaggaagaggaggacttgacactccagccccgtcctgcctccagtgctcctgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcttggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatc

SEQ ID NO: 847 - DNA, 3763 bp, Homo sapiens
acggtggtggcgtggagacgtgggggcgcttccggcagcggcggcggtggtgaaggccgatgctgtgggggtgggcgtggagagaattcttctgtgggtcctctggtgttgagtggtcggcttggtgtggtgtgcggaggagctccaggcccgtcggcgcggagtggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaagtcaccttcagggcaggtgacattacggagttaaaaattctggagataccaggacctggagacaaccaacattttggagaccttcatcaaacagaattaggcccctctggtgctggctgccaagtgggcatcaatcagaatggcacaggcaagtttgtcaagaagccagcctcttccagcagtgcccctcagaatatccctaagaggacagatgtgaagagccaggatgttgccgtttccccgcagcagcaacagtgctcaaagagctatgtcgacaggcacatggaatccttgagtcagtccaaaagtttccgtcgtcggcacaactcctggtcatctagtagcaggcacccaaatcaggcaactcccaagaaaagtggtttaaagaatggccagatgaagaataaagatgacgagtgcttcggggatgatattgaggagatcccagacacagattttgattttgaagggaacctggctctttttgacaaggcagctgtgtttgaggagattgatacctatgaaaggagaagtggtacccgttcccggggcatcccaaatgaaaggcccactcggtaccgccatgatgagaacatcttggagtccgagcccattgtctatcgacggatcatagtgccccacaacgtgagcaaggagttctgcacggactctggcctggttgtcccaagtatttcctatgagctgcataaaaagctgttgtccgtggctgagaagcatgggctgacccttgagcggagactggagatgacaggtgtgtgtgccagtcagatggcactgaccctcctcggaggacctaacaggttgaatcccaaaaatgttcaccagaggcctacagtggctctactgtgtggacctcatgtgaagggggctcagggtatcagctgtggaaggcacctagccaaccatgatgtccaggtcatccttttcctgcccaattttgtcaagatgttggaatctatcaccaatgagctgtcgctcttcagcaagacccaaggccaacaagtgtctagcctcaaagatctgcccactagccctgtggacctggtcatcaactgcctggattgccctgagaacgtcttcctgcgcgatcaaccctggtacaaggcagctgtggcctgggccaaccagaaccgggcaccagtactcagcatagaccctcctgtgcatgaagtcgaacagggcattgatgccaaatggtcactggcactgggcctgcctctgccactgggggagcacgcaggccgtatctatttgtgcgacattggcattccccagcaggtcttccaggaggtgggcatcaactaccactcgccctttggctgcaagtttgttatcccactgcactctgcttagagggttcctgcgcaggcaggactctgctgtcccctgctgctcctgataacaaacgccttaaggatatgaagcttcatggaccttgttaaagttttttctcttttgggtttgtttcttctgtgagagaacagaacttacttaaaactgacctgtcacttgctcttagccagggaagtctttcccactgggttccgggctgggtggcaggctgagcgtgcagcaactccaggcatctctaccctcagccccctgcacggccaggtgggcctttgtttacagccgtaggcagctctcaagactgtgtttcaggtttacagccactgggcctgggcacacacattgaagagtgggccaggtcctgtctgggggcctgtacctgctctatttcagagcttgtggctttgtgtctcccctgctttccccacgcagacagcccttcctctgtagaaccagctgcacggcagctgtccaccagagggcagacctgcactctccattcatgtccagggctgtgacagaccaggccttcccctagccccacaagttgatttggggggttttgacccttactcctgagctgatccaagttttatgctgatttttccaaggatctctccctccttttccctccatcactcagaggtagggaagggggcggcattaggatggtgttactgtattgggattttatgttgttctgtcgtcttcagcacaggtagtataaggttatattactgtagaaccacagtgcccatcttgccagcagtgcccgcccccaccctcaaagctgagcaggttgagcctttgcctagtctggggccagacccctcagatggggatatccctgggggagcctggtgctgaaccagaagaggcttcctggtgcttctgtcctaggccaccactcctccagccctttgcccgcacatacatgccccacctactctttcatcccctctgcccttcccctgaaacggtcctttgcagctgtcatcccagagcaggcagatgggctcccgtgcttgagctccaccccagctcttacatcatctgggctttgaaccttttacatttgtccagtctagatgagtaggcttggggccagcaccctgtctcaaagatggcaaaatgaggctagttctggatgagctagctggtgtgggttccaaccataggaacacactgatgctcaaatcctaaggtgccaagctctaggccctggaggctggtagaacaggatctatgcctggaatcctggcagggattcctgtcaaggacttgtgtttaagcctgcttcagggcttcaggctgcttctgctctgtgtctgcccaggctggctgagcgggtggatgggtggacagaagggctcaccaaggattgtggacatagggtaggccctggtaccacgggtttcaggctgttatcacttcccttgtaggaacatagccagaagcagatgagccagggtagagggctggcccctcctctcatcttcccttcagtcttaaattgtctccagcgatgggaagaggccagggactgtaacccttgtgctgtgtattctctgagcctctgctcactctcagggccaagcagctcccaagccggggccctctcttggccaaaatctgaggagcagtctaggttacaggctttttggtaggtaggttctggctgcctgttaatgcagttaggccccctgattaggtacagtgagaaacaagctagaacaaccctggcccagaagactgtccactccagcaagatccagggatgatagccttgcagggccactgggagtttgtgcccaagcttctccctcttctctccccagggggcactgggactggtccctgccctcatccttagcctgggccttccccagaggtattaaagagaagtatgattcctctgtcttcagttcttttcaggggcatcctgcccatagtacccagttcccaaggggcccccagtcacgtggtgaagcctagcactcatgcagctcttagggaaccaaaaaccagcactgaaataaagctgaatgactgactga

SEQ ID NO: 848 - DNA, 1364 bp, Homo sapiens
ggccaacagggggcgccgtcgtgggggcggcactgggagcgccttccggagagacgcagtcggctgccaccccgggatgggtcgctggtgccagaccgtcgcgcgcgggcagcgcccccggacgtctgccccctcccgcgccggtgccctgctgctgctgcttctgttgctgaggtctgcaggttgctggggcgcaggggaagccccgggggcgctgtccactgctgatcccgccgaccagagcgtccagtgtgtccccaaggccacctgtccttccagccggcctcgccttctctggcagaccccgaccacccagacactgccctcgaccaccatggagacccaattcccagtttctgaaggcaaagtcgacccataccgctcctgtggcttttcctacgagcaggaccccaccctcagggacccagaagccgtggctcggcggtggccctggatggtcagcgtgcgggccaatggcacacacatctgtgccggcaccatcattgcctcccagtgggtgctgactgtggcccactgcctgatctggcgtgatgttatctactcagtgagggtggggagtccgtggattgaccagatgacgcagaccgcctccgatgtcccggtgctccaggtcatcatgcatagcaggtaccgggcccagcggttctggtcctgggtgggccaggccaacgacatcggcctcctcaagctcaagcaggaactcaagtacagcaattacgtgcggcccatctgcctgcctggcacggactatgtgttgaaggaccattcccgctgcactgtgacgggctggggactttccaaggctgacggcatgtggcctcagttccggaccattcaggagaaggaagtcatcatcctgaacaacaaagagtgtgacaatttctaccacaacttcaccaaaatccccactctggttcagatcatcaagtcccagatgatgtgtgcggaggacacccacagggagaagttctgctatgagctaactggagagcccttggtctgctccatggagggcacgtggtacctggtgggattggtgagctggggtgcaggctgccagaagagcgaggccccacccatctacctacaggtctcctcctaccaacactggatctgggactgcctcaacgggcaggccctggccctgccagccccatccaggaccctgctcctggcactcccactgcccctcagcctccttgctgccctctgactctgtgtgccctccctcacttgtgggccccccttgcctccgtgcccaggttgctgtgggtgcagctgtcacagccctgagagtcagggtggagatgaggtgctcaattaaacattactgttttccatgc

SEQ ID NO: 849 - DNA, 2881 bp, Homo sapiens
cgttgtcgggttcgactggaggggcgggggagtcacctgcgagcggctgcgctggcggccagcccgcccaccgcgtctggatcgcgccggctgcgcggggctgcggacagcacacaccctggaaggccccggcggggaacgggcagagtccgcgccctgcgtccgcgaccaggaggatcggaccttcgccttcgctgtcgccgccgccgccgcccgcggccgtcggggctattagtgaaagatggtggatcgcttggcaaacagtgaagcaaatactagacgtataagtatagtggaaaactgttttggagcagctggtcaacctttaactatacctggacgagttcttattggagaaggagtattgactaagttgtgcaggaaaaagcccaaagcaaggcagtttttcttgtttaatgatattcttgtatatggcaatattgtcatccagaagaaaaaatataacaaacaacatattattcccctggaaaatgtcactattgattccatcaaagatgagggagacttaaggaatggatggctaatcaagacaccaactaaatcttttgcagtttatgctgccactgctacggagaaatcagaatggatgaatcatataaataaatgtgttactgatttactctccaaaagtgggaagacacccagtaatgaacatgctgctgtctgggttcctgactctgaggcaactgtatgtatgcgttgtcagaaagcaaaattcacacctgttaatcgtcgccaccattgccgcaaatgtggttttgttgtctgtgggccctgctctgaaaagagatttcttcttcccagccagtcctctaagcctgtgcggatttgtgacttctgctatgacctgctttctgctggggacatggccacatgccagcctgctagatcagactcttacagccagtcattgaagtctcctttaaatgatatgtctgatgatgatgacgatgatgatagcagtgactaaggacacatttgggagtatttaatcaggtgtggctatctgagaaatcaactttgggggaaatgtaagattctgagctctctctctgttttgttctagccatgaatttgcctgagaaacttgtaacctatgtgcctcaatatattccatagaaagtaggtccccctgccttctcccactcctcacactcttctacagggataggcttttgcaaatatatcagataaattttttgtttcttgtttatttttaggttattttcttggaaggttgggaaaagatgtttgttttaacaggtcatgtactacgttgttgttttcatttctgttataagtaaaactaaaagcacagaatggtgggaaaggggctataatgtggttcattaataatgttagcagcttttttctaaccatcctgtctaatggttaagacaccagtaacaaaaacacatgatttggaaatactttggctttttcatatacctagtggtgccttatcataatagcactgttacatgaaataagcccctaccttcttactttctggtttgttgaaaaaatacactggtgctctttgaagtgataaaatgagtgtttatgaatgggtgtaattaggaaatacttctcatctgacagctacaaataactaagtttggaggtattttcactctatatgaataaatatttttccataaaatagttgtgattatatttttgttttatataggtcccaaattataattgtcaaatatatattttaaattaataaaagttgtcattcttaggaatttggtttgaaatttatcagttatacagaattgtcatactgcattagcttctacctttagtaagacatattttttaggtataaattcttatgctttaacattatttctggattgaaaatcttataaaacccttgaaaataaacagtctcttttttacaaagcctgtgttagagcacagatttacctaggcttgaagatttggaagaaataatatgtaagaatggcctcaaggcagaccactttaagtttggctagacttcatatcgtggaagtattgtctatttcagtgtgaaactatcttgaatttgcaaatatagtgttatattttataaagttttgtaaaatcccaaacaatatttctatttttgtaaaacaattgtatgtataatctgtatttgaaatcattttgcaatctatggaaatagagtagcaattgctatttctaaattgtgaactttaagtcaatctagatttattttgagaagtaattgttcactctttacttttgaggcagccattaggttgaaagtatatatttatcatataaaacttgatgcgttttgcactactctttccatttatatgctgcaaacaactacagtctttgaaatatggaaaatcagcagtctaaagtttgttttaaattctaaatttaaaaaatcttcaaatctgaatataccgcaaatgtcatgagaagtttgattcagtaacttgtgatggaggattctttggtatcttactgtttggttaaggcactaattttacttacctattagattttgaaagtatctgagatatacaaatctccctgtaggaaatgtgaaagaaaagcacaacaaaactagggttttttgttcatttgcttgcttttatgattttttttggtttgttttaatatcaggtggatttttgtttctaagcaatatatacataaaatcaaccaacatatctgaaaaggatcatgaaacctgagaaatgctaatggagatttgctggtacataggaatctagcaaattcaggaaccaaggggaaatgttgtgagataacatttacattgtcaacctttattgactttgtttttacaataaaaaatattttacaactt

SEQ ID NO: 850 - DNA, 4458 bp, Homo sapiens
caggcggcggcggcgcagttgcgagtgcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatcctttgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggacgatgacctgaaacctcgaggcctcacgggcatgaagaacctcgggaactcctgctacatgaacgctgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagccatctctgagaaggagcggatgaaggaccgcaagttctcctggggccagcagcgtacaaactcggagcaagtggacgaggacgctgatgtggacactgccatggctgcccttgacgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagccttgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtcctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctgtaagtcgccccggctggtccctccatggcactctgggtcctctcctcactctccagagaccctcacatgtccttttgaacatccaaagagcaggtccctgaaagcaccttcctggaggatgtgggagggccctggacatggcccggccccactgctgagtgcccgtgtccccacagccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccacctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgtt

SEQ ID NO: 851 - DNA, 1755 bp, Homo sapiens
gcggccgccgccccaccgtaggtccgtagcaggtggtcgaagtcgggcctccccgcgggcgtcacccagcgccgccggctgccccagccctgcgtgaaggcgctggaaaacacgcagggcaggttgggcagcaagaagccccgcacaaagtcggcgtaggagaaggcgcccggctccgagacgaaggctacccggcccggagcctggccgacgccggggacatcgacccccaggcctcggaagtggctgtcggcgagggcgcgcgtctcgcggtccatccagctcagcacgggtcgaaggaccctcctcctcacttccgccggagcggaaacggtgaggaccagcctcggaaccagaagacgcagggcgccgcgtttctgccccgccagcgcctggggctccgggcctgcacgcatgcgcgcggctcgccgcggtcttcactgcgcaggcgccgagcggccgaggcgccgcggtcggctctgggactcgtctggcgtccctcagaggcagaagaggcctggaccttggcgcacacagacccaggaacagatgagcagggatgtctgcatccacacctggccgtgcacctactacctggagcccaagaggcgatgggttactggacagctgtccttaacatcgctgtcgctcaggttcatgactgacagcactggagagattctggtcagcttccccctctccagcatagttgagatcaagaaggaggcttcacattttatcttcagctccatcaccatcctggagaagggccatgccaagcactggttcagctccctgcggccaagtcgaaatgtggtcttcagcatcatcgagcatttctggagggagctgctgctgtctcagcctggagccgtggcagacgcatctgtcccaaggacccggggcgaggagctgacgggactcatggctggatcccagaaacgcctggaggacacggcgagggtcctgcaccaccagggccagcagctggacagcgtcatgagaggcctggacaagatggagtcagacctggaggtggcggacagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccagggcttccggcctatgtcgctgtcaacccagacagtgttggtgatgctttgctccgagtctgcaggagctttgtggagacagagactttcctag

SEQ ID NO: 852 - DNA, 2103 bp, Homo sapiens
ctgttcttgtgaggctgagggtctggggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtac

SEQ ID NO: 853 - DNA, 5763 bp, Homo sapiens
aaaagggcggtggggcggggggcggggcagggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatgtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtcctttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaata

SEQ ID NO: 854 - DNA, 2236 bp, Homo sapiens
ctactcatggcgcctgccctggttggcgatgtgttaccaacgtctggcctgtcccagcccaaggctccgcgtggcgaccaggcccagcactgggaggctgtgcagagcgtggcgtttactgcttattgctactctgcagaggttggcaacatctgacccgctctactggcaggaaacaggctcgggggcattgggaaaacgatcaaggccacttggctggacactggcggagcctcgcactcaaacctgtcgggcctcaactccgtgccaggccaacaagttgccctgggcagttcaagctggggataagggggatggggagcaggaagacagcagcaaggatgcgatcccgaaggaactttcctcctcagactgctccatgtccatgtggggcaggtcgctgaagagttcgaaaccgtgctcagcaccgcgtttggggcatgtgagaccgagaggctttgggaaactgacgccgctgtgagaacgagtttagcggagtctatggacgctgcgagcttgtggccacaagagggcgccccggagcacggcccagtccccgcccccgctggatggggcccggcctcttcccagcgttcctcctccggccccaggtcaccgccagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccagggctcaagggcgagcctcctgcccaggagcctctcttgtcccaatccagggccagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattagacccc

SEQ ID NO: 855 - DNA, 860 bp, Homo sapiens
gtcccggcccgagcctccggccgcccgccgggtttgtcccgcgatccccgaccatgcccgccgacctcagcggtacttggaccctgctcagcagcgacaacttcgagggctacatgctggccctagatggagtctcgctctgttgctcaggctggagtgcagtggtgtgatcttggctcactgcaacctccgcctcctgggttcaagcaattctcctacttcagcctccaaagtagctgggattacaggtatgtgccaccatgcccggctaattttgtatttttagtagagatggggtttctacatgttgatcaggctggtctcaaactcctgacctcaggtattgactttgccactcgtaaaatagccaagttgctgaagccacagaaagtgattgagcagaatggggattcttttaccatccacacgaacagcagcctaaggaactactttgtgaaatttaaagttggagaagaatttgatgaagataacagaggcctggacaacagaaaatgcaagagtttggttatctgggacaatgacaggctcacctgtatccagaagggagaaaagaagaacagaggctggacccattggatcgaaggagacaaactccacctggaaatgttctgtgaaggtcaagtgtgcaaacagacattccagagagcctgatccacatccagcagcagagcccacttgtggctgcagctttatgccaaattatattgcagactgaacagacgtttatctatcccatttggcgacgaggactcgtggctggagagagccacacagcgtgtaacctgaagtcatctagattatggggaaactgctcagcttcaataaacctgtccaaatga

SEQ ID NO: 856 - DNA, 2912 bp, Homo sapiens
tttgttgttgacaactgtcagcttcgacctccttctcctcacaaccccgtctaaatggggtttgtaatcctccttcccacccactctcttcactccctggggcaagaatgttgactcctgctctccgtcacctgtcaggatccatcctcctgtcactggcttatatggacacgtcagcccaccgtcacgtgaccgcaggctgctaaaaacagctccagcacccactccaaaccagggcctgaaacaatgtcctccaccgagagaaacgtaaaggacacttgatcacacaatccctggaataatatccaggaaacacttgctggagccactcgcagcacccttccctggcagcacacttggggacagcgaggagatgagcgcatctctgaattacaaatctttttccaaagagcagcagaccatggataacttagagaagcaactcatctgtcccatctgcttagagatgttcacgaaacctgtggtgattctcccttgtcagcacaacctgtgtaggaaatgtgccagtgatattttccaggcctctaacccgtatttgcccacaagaggaggtaccaccatggcatcagggggccgattccgctgcccatcctgtagacatgaagtggttttggatagacatggggtatatggacttcagaggaacctgctggtggaaaatatcattgacatctacaagcaggagtccaccaggccagaaaagaaatccgaccagcccatgtgcgaggaacatgaagaggagcgcatcaacatctactgtctgaactgcgaagtacccacctgctctctgtgcaaggtgtttggtgcacacaaagactgccaggtggctcccctcactcatgtgttccagagacagaagtctgagctcagtgatggcatcgccatcctcgtgggcagcaacgatcgagtccagggagtgatcagccagctggaagacacctgcaaaactatcgaggaatgttgcagaaaacagaaacaagagctttgtgagaagtttgattacctgtatggcattttggaggagaggaagaatgaaatgacccaagtcattacccgaacccaagaggagaaactggaacatgtccgtgctctgatcaaaaagtattctgatcatttggagaacgtctcaaagttggttgagtcaggaattcagtttatggatgagccagaaatggcagtgtttctgcagaatgccaaaaccctgctaaaaaaaatctcggaagcatcaaaggcatttcagatggagaaaatagaacatggctatgagaacatgaaccacttcacagtcaacctcaatagagaagaaaagataatacgtgaaattgacttttacagagaagatgaagatgaagaagaagaagaaggcggagaaggagaaaaagaaggagaaggagaagtgggaggagaagcagtagaagtggaagaggtagaaaatgttcaaacagagtttccaggagaagatgaaaacccagaaaaagcttcagagctctctcaggtggagctgcaggctgcccctggggcacttccagtttcctctccagagccacctccagccctgccacctgctgcggatgcccctgtgacacagggggaggttgtacccactggctctgagcagaccacagagtctgaaactccagtccctgcagcagcagaaactgcggatcccttgttttaccctagttggtataaaggccaaacccggaaagccaccaccaacccaccttgcaccccagggagcgaaggtctggggcaaatagggcctccaggttctgaggattcgaatgtacggaaggcagaagtggcagcagccgcagcgagtgagagggcagctgtgagtggtaaggaaactagtgcacctgcagctacttctcagattggatttgaggctcctcccctccagggacaggctgcagctccagcgagtggcagtggagctgattctgagccagctcgccatatcttctccttttcctggttgaactccctaaatgaatgatattcattccaactgctgcccctctgtctgcctggctgagatgcatgtgggcagcaggaagcccaagtgaaattaatattatgcagatgatgaaagggacctctgaacaggatttctgcaaaaatagccccaaactgcaattccatatgacttatctaacatcttggggggaaagaatattttgagaaaatagttgcagaaagcactggaaataataaacttgatcttatacaaatcttctattgtgtggaaaatgttgtgaagggtgtgtaggtgtggtacatgtgtatgtcactaacaagtggcaaatggtgaaaaaagtggtcactatgcttttgtctctcataggcactgactttttgttattatattatggtagctttcatttcctttactctttaacagtgcaggtggtcagtgaaaatcagtgtcaactcagaagtgactgatttatcaatacatggacaaaaagtaaatcattgaccaaagctatgaaatgtttcacaaagttttcctcttttgcataacagatgtcactggatgtacattcagaaatgttctttgaatttggtgacactttcatggtccagaaagctgaaggcctgggcatctcttgtgacatttttctaatattagttttagattttcacgtattaggcactttagttgaatcttccagcaaaagctgtctactttctcttttattcactgtggcaccaatctggtaaattgtagaacaattgcatgtgtttaaatatatatacaaacatatcacacattaaatatatatatatttaaatcatgctttgttaatatttgtcccaccataatgcctccttcagaacataagtgtaactttatatgaactcttaaataaatgatgtttttaaaa

SEQ ID NO: 857 - DNA, 1878 bp, Homo sapiens
atatgaatcattactccttacccaggcagtaatgttcccgaagttttctcttcgttctatgtttcatggagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacgagtgccagtctttaggcctatggatctaatggttgaggccagtccacgaagaatatttgccaatgctcatacatatcacatcaactcaatttctattaatagtgattatgaaacatatttatctgcagatgatttgcggattaatctttggcatctggaaattacagacaggagttttaacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaattgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtgcatgaatacctcagaagtaaactctgttcactgtatgaaaatgactgcatatttgacaaatttgaatgttgttggaatggatctgacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattcttactgtggcttgtagcattcctcctcttctgg

SEQ ID NO: 858 - DNA, 887 bp, Homo sapiens
acctccggaaaccgtagattccgggcggtcggagccgccgggagctgtagttctcccgcggctcagagaagtaggcagagagcggacctggcggccgggcagcatggcggggctggagctcttgtcggaccagggctaccgggtggacgggcggcgcgccggggagctgcgcaagatccaggcgcggatgggcgtgttcgcgcaggctgacggctcggcctacattgagcagggcaacaccaaggcactggctgtggtctacggcccgcacgagatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggcctctatcttgctgggggactgaccacccagccacccatgtccagaataaaaccctcctctgcccacac

SEQ ID NO: 859 - DNA, 4567 bp, Homo sapiens
agaccaggtagtcgctgcccagccggtcaggacgtgggacgcaaggggcaatcctgcccggttcgcaggtccgaggcgggcgcggtggcccttcgggccccgccccgccccgccccgccccgccccgcccaccggcagcccggccacgacccaagcggaggccgcgccgacgcctgcgcaatgtatgcggagagccaccaccgcctccggtcccgactccgatgatggcggacggcgccgcagctggcgctggcggcagcccatccttgagagagctgcgggcacggatggttgctgcagcaaacgagattgctaaggaaaggaggaagcaagatgtggttaatcgtgttgcaacccattcctcaaatataagatcgacatttaaaccagtaatcgatggatccatgcttaaaaatgacataaaacaaagattagcaagagagcgcagagaggagaaaaggagacagcaagacgccaataaagaaacacaactacttgaaaaagaaagaaagaccaagctccaatatgaaaaacagatggaggaaagacagagaaagctgaaggagcgaaaagagaaagaagaacaacggagaatagctgcagaagaaaaaagacaccagaaggatgaagcacaaaaggaaaaatttacagccattctttatcgtactttggaacggaggagacttgctgatgattatcagcaaaaaagatggtcatggggaggctctgcaatggcgaattctgagagcaaaactgccaataaacgatctgcatctactgaaaaacttgaacagggtacttctgctttaatcagacaaatgcctttgtcatctgcaggccttcaaaattccgttgccaaaaggaaaacagacaaggagagaagctcatctttaaatagaagagatagtaacctacattcgtctactgataaagaacaagccgaaaggaagccacgtgttacaggcgtcaccaattatgtaatgcagtatgtcactgtacccttgcgtaaatgtactagcgacgaattgagggctgttatgtttcccatgtcgacaatgaaaatacctcctcaaacaaaagtagaagagtctcccttggagaaagtagagacacctcccaaggcaagtgtggatgcacccccccaggtgaatgtggaagtattctgcaacacaagcatggaagcgtcccccaaggcaggtgtgggcatggcccctgaggtgagcacggactcattccctgtggtgagcgtggacgtgtcgcctgtggtgagcacatatgattctgagatgagcatggacgcatcccccgagttgagcatagaagcactcccgaaggtggacctggaaacagttcccaaggtgagcatagtagcatccccggaggcgagcctggaagcacccccggaagtgagtctggaagcactgccagaggtgagcgtggaagcagccccagaggggagcctggaagcacctcccaaggggagcgcagaagtagcccccaaggagagtgtgaaagggtcacccaaggagagcatggaggcatctcctgaggcgatggtgaaagcatcccccaagacatcccttgaagcaagcatggaagcatctcccaaggcaaaagcgagagacgctccaaagaaatcagaaatggacaaacaggccttaatccctattgccaagaagcgtctatcatcatacactgagtgttataaatggtcatcatctcctgaaaatgcttgtggtctgccgtctcccatcagcactaacaggcaaatccaaaagaactgccctccatcaccattaccacttatttcaaaacagtcaccacagacttcttttccttataaaataatgcctattcaacacaccctgtctgtgcaaagtgcatcaagtactgtcaaaaagaaaaaagaaacagtttctaaaaccactaacagatgtgaggctttgagccaaaggcatatgatctatgaagagtctggtaataagagtactgcaggtattatgaatgccgaggcggcaacaaaaattttgacagaattgcgccgccttgctcgtgaacaaagagaaaaagaggaagaagaaagacaacgggaagaaatgcagcaaagggtcattaagaaatcaaaagacatggcaaaggaagcagttggaggccaagcagaagaccacttgaaactcaaagatgggcagcaacaaaatgagactaaaaagaagaaaggatggctggatcaggaagaccaggaagcaccactgcagaaaggggacgccaaaataaaagctcaagaggaagctgacaaacgcaagaaagaacacgagagaattatgttacaaaatttacaagaacggttagaaaggaaaaagagaatagaagaaattatgaagcggacaagaaagacagatgtgaatgcctcaaaggtcacagaaacatccagccatgacatatatgaagaggctgaggctgacaacgaagaaagcgacaaggactcattgaatgaaatgtttccatcagccattctaaatggcacaggctcacctaccaaatttaaaatgccgttcaacaatgccaagaaaatgacacacaagctggtatttctagaagatggtaccagccaggtccgtaaagagccaaaaacatattttaatggcgatttgaaaaacttcagacaaaaaagcatgaaagacacttcaatacaggaagtagtttcaagaccatcttccaaaagaatgaccagtcacacaacgaaaaccagaaaggcggatgaaaccaacaccaccagcagatcctctgcacaaacaaaatctgaaggattccatgacatcttgccaaagtcctcagacacctttagacaataagagaagaagcaaacctgtttctcctcatttggatatgtaaaccttactcagcctgggagatgaatacatcttccactctggataactcaactcctgggcccatcagtcctcaaatttttctgcttctgacttgaacctggtaaaggaagtgacaccgaaaaattgaaagaaactgtcaaaaggccactttgatgtatatctcagatgttaaagtcatcttattctcttgtgtctaagcaagagttctaagtaaagagtggtttttgttttctttggaaaatcatcattgtctctcattcttgtgttgtcccaccaatgtgtttgctggagtgagtgcatcaaggatgctttcctgaaactgtaactgtggagtttctagaagaatctgattgcagaactaattctctttcagtatatatttgaaatcttaaagtaatgctttttctttttctttttcttttttttttttttgagacggagtcttgccctgtcgcccaggctgcagtgcagtggcacaatctcggctcactgcaacctccgcctcctcatctcaagcaattctcctgtctcagcctccccagtagctgggattacaggcatgtgccaccacacctggctaatttttttgtattttagtagagatagggttttaccatgttcaccaggctagtctcgaaatcctggcctcaagagatccacccgtcttggcctcccaaagtgttgggattacaggtgtgagccactgcacccagccaagtaatgctttttctgtgtaccagtgacaattttgacagctaaaaactcacagttgatcttgtagagaacagaatagattatgcaagggccgcaggatcgctcacaagagctgtcagattgtttctaatataaaaataccaaaggttgcaaaatccagcaaattgtattttactgtgatatatgtatatttttaactctacccatctgtgccagtgagtacacaggcactaataacctgaaatgctgggagtcctgtaaagccccatcttggaacagtcagcacctttcatgctcttgtcagtgtttccttttgaaggacatattggtgtttatctacagaaacatatattatttttattgtgtacataaaggagtatatggctgttgtcccgtggggtatgtttaattcctctaaatgtttaaagtacttttctgcctgtactctccagttctgtcgttgagtatacactcaggcttgagatacaaccaaaatttgcttgcctttctctagccactggctgccagtgagttcgtgtgatgggcacacagaaatgcacacagatgtacatacacgtatgtatgcacacacagtatatgattccataaaattcaaatgcagattaattctcctaatgagttttcagtgttgaatcgtaaatagtctgaagcaggccagtgttccttttggctgccagtcttggattagtaaaaggaggtaattctttcagattccctggttctttgccactcagagtattgtacttttgatatagaatagagaaggttacctttggtttaaaaactatttttatatactagctctttcatgtataaaacagagacaatcatcctaacaaaagagttcctgttatttttctgcacaaatgtcttgtgttgaaacactgttacagttccatataaatgtgtgctatataaaataaactttggagataaaacaa

SEQ ID NO: 860 - DNA, 6817 bp, Homo sapiens
atgtgctcgacgcccggaatgccggcgccgggggcctcgctggccctgcgggtgtccttcgtggacgtgcatcccgatgtgatcccggtgcagctgtgggggctggtgggcgagcggcggggcgagtacctgcggctgagccgggaaatccaggaagcggcggccacgcgcggccagtgggcgctgggcagcgcctcggcctcgcccggcgagctgtgcctggtgcaggtcgggcttttgtggcaccgctgccgcgtggtcagccggcaggcacaggagagccgtgtcttcctgctggacgagggccgcaccatcacggccggagcaggctcgctggcgcctgggcgcagagagttcttcaatttgccctcggaagtgctgggctgcgtgctagcgggcctggtgccggcaggctgcggcgcgggctcaggcgagccgccgcagcactggcccgccgacgccgtggacttccttagcaaccttcagggcaaggaggtgcacgggtgcgtcctggacgtgctgctgctccatcgcctggtcctcctggaggtgcctgatgtgttccaacagatgcgggagctgggcctggctcggcgggtgcccgacagcctcttccgttcgctgctggagcgctatctcacagcggccactgctagcgtgggctccggggtcccggttctctcgcgagtcccgctcaagcaaaagcagcctggtctggattacttctatccccagctgcagctgggcgtgacggaggccgtggtcataacccaagtgtgccatccccaccgcattcactgccagctccgcagcgtctcgcaggagatccaccgcctctccgagagcatggcccaggtataccggggttccacggggacaggggatgagaactctaccagtgccacctgggaggagagggaggagagcccagataagccgggctctccgtgtgcatcctgtggcctggatggacattggtacagagcactgttgcttgagacttttcggccccagcgctgtgcccaggtgcttcatgtggactatggaaggaaggagttagtgagttgcagcagccttcggtacttgctgcctgaatattttcgaatgccggtggtgacctacccttgtgctttgtatggactctgggacggtgggagaggctggtctcggtcacaggtcggtgacctgaagacactgatactaggcaaggcagtgaatgcaaagattgaattttattgctcctttgagcatgtgtattatgtcagcctgtatggagaagatgggattaatctgaaccgtgtgtttggagtacagtcgtgttgcttggctgaccgagtccttcagagccaggcaacagaggaggaggaaccagaaacatctcagtctcagtctcctgctgaagaagtagatgaagagatttcactcccagccttaagatctatcaggttaaagatgaatgccttctacgatgcgcaggtagagtttgttaaaaatccttctgagttttggattaggttgaggaaacacaatgtcaccttcagtaagctgatgaggagaatgtgtggtttctattcctctgccagtaagctggatggtgtagttttgaaacctgaacctgatgacctttgctgtgtcaagtggaaagaaaatggttattatagggccatagtcaccaaattggatgacaagagtgtggatgtattcttagttgaccgaggcaattcggaaaatgtggactggtatgacgtaaggatgctgcttcctcagtttaggcagctaccaatattggctgtgaagtgcaccctggctgatatttggcctttgggaaaaacttggagccaggaggcagtttccttttttaaaaagactgtgctccacaaagaattagtcatccatattcttgataaacaggatcatcaatatgttattgagattcttgacgaatcaagaacaggggaagaaaacattagtaaggtaattgcccaagctggatatgccaagtatcaggaatttgaaacaaaggaaaatatcctggtaaatgcccactccccagggcatgtttcaaaccactttactacggagagtaacaaaataccttttgccaagactggagaaggagagcagaaagccaagagagagaataaaaccacatctgtttcaaaagctttgagtgacacaacagttgtaacaaatggttcaactgaactagttgtgcaggaaaaagtgaaaagagcatctgtttattttcctcttatgcagaattgcttggaaattaagccaggctcctctagtaaaggagagctggaagttggaagtacagtagaagtcagagtgtcttatgttgaaaaccctggctatttctggtgtcagctgaccaggaacatacaaggacttaaaactctaatgtctgatattcagtactattgcaaaaatacagctgctcctcaccagagaaacacccttgcttgtttggctaagcgaacagtaaacagacagtggtccagagcacttattagtgggatacagtctgtggagcatgtcaatgtaacatttgtagattatggagacagagaaatggtatctgtgaagaatatttattcaattagtgaagaatttctgaaggttaaggcacaggcttttaggtgcagtctttataatttaattcaaccagttggccagaatccctttgtttgggatgtaaaggcaatacaagctttcaatgaatttatagataatgcatggcaaaaaaatctagaattaaaatgtacaatatttgctctggcttcaattaatgaagaactgtttaacattgtggatttgctaaccccctttcagagtgcatgccatttcttggtagaaaagagacttgcaagaccagtaaaacttcagaagcctttggagtcctctgttcagctacattcctacttctattctacacatgatatgaaaattggaagtgaagaattagtttatataacgcatattgatgacccttggacattttattgccagctggcaagaaatgcaaatattttagaacagttgtcatgtagtattacacaattaagtaaagttttgctgaatttaaaaacatctcccttgaaccctggaaccttgtgccttgccaagtatactgatggaaactggtataggggcatagtaatagagaaagagccaaagaaagtcttctttgttgattttgggaatatttatgtagtaacaagtgatgatctgcttccaatacctagtgatgcatatgatgtcttacttttgcccatgcaagctgtcagatgttcattatctgatattcctgatcatataccagaagaagtggtggtgtggtttcaggagactattttagataagtcattgaaggctttagttgtagcaaaagatccagatggaacactgattatagaactatatggtgacaatattcaaattagtgctagtattaataagaagttggggctacttagttacaaagatagaataagaaaaaaagaaagtgaagtcctctgttctacaactgaaactcttgaagaaaaaaatgagaatatgaagttgccatgtacagagtatttaagtaaatcagtagggtacaagttacctaataaagaaattttggaagagtcatataaacctcagatcaactcatcatacaaggaactcaaacttttacaaagtttaacaaaaacaaacttagtcactcaatatcaagactctgtgggaaataaaaatagtcaagtgtttccattaacaacagaaaagaaagaagaaatttctgctgagacacccttgaaaacagcaagagtagaagctactctttcagagagaaaaataggagattcatgtgacaaagatttgcctctgaaattttgtgagttcccacagaagactataatgcctggatttaaaacaactgtatatgtttctcatataaatgacctttcagacttttatgttcaactaatagaagatgaagctgaaattagtcatctttcagagagattaaacagtgttaaaacaaggcccgaatattatgtaggtccacctttgcaaagaggagatatgatatgtgctgttttcccagaagataatttatggtatcgtgctgtgatcaaggagcaacaacccaatgaccttctctctgtgcagtttatagattatggcaatgtttctgtggttcatactaacaaaataggtaggcttgaccttgttaatgcaatattgccggggttgtgcattcattgctccttgcagggatttgaggttcctgacaataaaaattctaagaaaatgatgcattacttttcccaacggaccagcgaggctgcaataagatgtgaatttgttaaatttcaagacagatgggaagttattcttgctgatgaacatgggatcatagcagatgatatgattagcaggtatgctctcagtgaaaaatctcaagtagaactttctacccaagtaattaaaagtgccagttcaaagtctgttaacaaatcagacattgacacttcagtatttcttaactggtataatccagaaaaaaaaatgataagagcttatgccactgtgatagatggacctgagtacttttggtgtcagtttgctgatacggagaaacttcagtgtttagaagtagaagtacagactgctggagaacaggtagcagacaggagaaattgtatcccatgtccttatattggagatccttgtatagtaagatacagagaagatggacattattatagggcacttatcactaatatttgtgaagattatcttgtatctgtcaggcttgtggactttggaaacattgaagactgtgtggacccaaaagcactctgggccattccttctgaacttctgtcggttcccatgcaagcctttccatgttgcctctcagggtttaacatttcagaaggattatgttctcaagagggaaatgactatttctatgaaataataacagaagatgtgttggaaataacaatactagaaatcagaagggatgtttgtgatatccctttagcaattgttgacttgaaaagcaaaggtaaaagtattaatgagaaaatggagaaatattctaagactggtattaaaagtgctcttccctatgaaaatattgactcagagataaagcagactcttgggtcctacaatcttgatgtaggacttaagaaattaagtaataaagctgtacaaaataaaatatatatggaacaacagacagatgagcttgctgaaataactgaaaaagatgtaaacattattggaaccaaaccaagtaacttccgtgaccctaaaactgataacatttgtgaagggtttgaaaacccctgcaaagataaaattgatactgaggaactggaaggtgaattagagtgccatctggttgacaaagcagagtttgatgataaatacctgattacaggatttaacacattactaccacatgctaatgaaacaaaggagatactagaactgaattcacttgaggtgccgctttctcctgatgatgaatcaaaagaattcttagaactggaatctattgagttacagaattctctggtggtggatgaagaaaaaggggagctaagcccggtgccaccgaatgtgccactctcccaagagtgtgtcacaaaaggcgccatggagctatttacactgcagcttcctctcagctgtgaagctgagaaacagccagaactagaactacctacagcccagctgcctttagatgacaagatggatcctttgtctttaggagttagtcagaaagcacaggaatccatgtgtactgaggacatgagaaagtcaagttgtgtagaatcttttgatgaccagcgcaggatgtcattgcatctacatggagcagattgtgatcctaaaacacagaatgaaatgaatatatgtgaagaagaatttgtagagtataaaaacagggatgccatttcggcattgatgcctttgttctctgaggaagaaagcagtgatggaagcaagcacaataatggtttaccagatcatatctcagctcaactacagaacacctacactctgaaagcctttactgttggatctaaatgtgttgtgtggtcaagtctaagaaacacatggtctaaatgtgagattttagaaacagctgaagaaggaacaagggttttgaacctttcaaatggtatggaggagatagtgaaccctgagaatgtctggaatggcatacccaaattggataagagtccacctgagaaaaggggtttggaggtgatggagatttaaccgtggatctatagctgtggccaatcagtcagaagctgcccttgaacaagtggcatcttacgcagaccaacagagtatttgagaaaattgaaaacatgtaaccacaagaagttgtcattttcaaaaacttctatataggtggaaaacaaattaggtctcaggttgatggtggggtgtgtttatagtgatcctgttatatatacagatctgggatctttcgtctttattgtcttacgtttctaattagttgggaggatttattttgctaaacagtttactaacacattacatttcaaaaactattttggtacctttcaaatacagtgtttaaattaaaatagaaaaataagggctcatgacaagtacattatttgattctacttaggatagctttttagcaggatctccttcagaatttttgtcttgactttgaatctttgcctgtttgtctaaacatttgactaacattctgtttgaatttggaagtattctaatacaagatttgaataaagtttatccttaaata

SEQ ID NO: 861 - DNA, 833 bp, Homo sapiens
tggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggagggtctcactctgccacccaggctggagtgcagtggcatgatcacagctcactgcagcctcaacctcccaaggcttaggtggtcctcctgcctcagccccctgctaagactacaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctg

SEQ ID NO: 862 - DNA, 3456 bp, Homo sapiens
gcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataattctgccaa

SEQ ID NO: 863 - DNA, 2428 bp, Homo sapiens
gttacttcatagcattctgaagacctgtccaccaattacagggctccttactggaaaaaccaactgctggggagtgccaagagtccctagcaacaccctgcagcgtttgaaatctgaggggaaaagactgtagtcagcccttagtggatgagagcgcctatgctccagaaacagcaggctcccaggatggacaccccgccccctgaagaacgcttagagaagcaaaatgaaaaactgaacaaccaggaagaggagacggagtttaaggaactggacggtctgagggaagccttggcaaacctccggggactgtcagaggaggagaggagcgagaaggctatgcttcgctcccgcattgaagagcagtcccagctcatctgcatcctgaagcggaggtcagatgaggccctggagcgctgccagatcctagagctgctcaatgcagagctggaggagaagatgatgcaggaggctgagaagctcaaggcccagggtgagtacagtcggaaactagaggaacgctttatgaccctagcagccaaccacgagttgatgctccgcttcaaggatgaatacaagagtgagaacatcaagctgagggaggagaatgagaagctgaggctggagaatagcagcctcttcagccaggctctgaaggatgaggaggcgaaagtattacagctcacagtccggtgtgaggccctcactggggagctagaaacgctgaaggagaggtgtgctcaggatgcctgccaggcacaggcgcgcgagaaggagctgctggagctacagagccagcaggcctgcacccacaccaaggagacagaacagctgcgcagccagctgcagaccctcaagcagcagcaccagcaggctgtggagcagatagctaaggcagaggagacacacagcagcctgagccaggagctgcaggccaggctgcagaccgtcactagagagaaagaggagttgctgcagctgtccattgaaaggggcaaagtgcttcagaacaaacaggcagagatctgccagcttgaggaaaagttggagatagcaaatgaagacaggaagcatgcgctggagcggtttgagcaagaggcagtggctgtggacagcaacttgagagtcagggagcttcagcgcaaagtagatgggatccagaaggcctacgatgaactcaggctgcagtctgaagccttcaaaaagcacagcttggatcttttaagcaaggagagagaactcaatggcaaactccgccatctctctccatagggaagtttctgcttcctctggcctgcaattcagaattcaaatatttgcgtcttagcattatggcaagagtaaagatgatatcccatttattatactttcaagcacaaaaggcaactcaaagaaaagctactttactatgatattgttgttattattgtaaagccattattaattttcatttctacacctagaatacacaagatttgccagatttccttctgtgccttagaaatcttaaatttactagtagtatcttctcctacccataagttattaattctcaacctcagatatcttcatttatgttaggattttaaattagcagcttctatgatttaagtcaatctaagtgcagtgagatgtgccattgtgaaaaataattagcacaattacccactgtagatagttaggcttatagtctcccatagttgagattgtaagcaaacatgtatcagcataatagcatgaatgctttgcagaaaaaaaaaagtgtctgactttattttattttgcgctagcttggaaaatgattgagatcaagttctttaacaaagaaggtcaattttattctgtatgagcaatatgattcaaataagttatacaaaacaacttttattttttctgcaagcttagataatattccattttttggttttctctttaaaaagaggatttagatgtgcaataatgcaaatatcagtagcttaatttaatattgcacgatatgctaatagacaattagacaatttggggtaacaaatcatagcagacgtgatctatagagtaactcagaaattgttttgtttctattagcatattttttgtaattaagattttccttttttaaaaaaatctaagctgaacgtgtgtatgtatgcttgcagcatttttgtagtaatacctacattttgtaagaatagttataaaaacatgatatatatatatgtaaagttcttaaaaaagttctcaaaggtagttatattttcttatcttcctgtaattaggtattgatatataaacattattatgaatacctctcaaaatagattgtaatgtaatatttttctcacccattttgctgaaggctaccaagttacataatgaatttacttaaaaaatatgacttggtgcctttttagtaaaaccatttccaagc

SEQ ID NO: 864 - DNA, 2344 bp, Homo sapiens
atttacgtgccgtgcgtcgccttggaaacagaggagcatccgcgacacccccgggagacccaccccagctgctgctgccacactcgcgggcgctgcccggtaatggcctgggggagtcccgagtccgacgcgccgctggcctcagcctggacgcggacccctccgcgagcgcgtctgtgacccacggaaccggcaggcgctctctgcttgtggcgcccagagggcggcgctgacacgggcgcgatccgggaggcgaggcagggcagggcactttcgtcccggggcgatcccaagagacgccggctctgggaccctcgccgggtcctcgtcccgcagcctcttctcggcctcccgcgatcctgcctgcgccctctgcccaggactcgtctctcacgtcggctccccgccagtctcgggagcctccgcttccctcggctcccgctagcccctcccgggacctctccccctccaccccctcccccaccccggaggccgggctggacgcgacccagagcctccgccacccgcttctgccactcaatggaggacggtctgctggagatcatgaccaaggacggcggcgacatgccggcgcccctggaggtgtccaccgtgccggcagtgggggacgtgatctccggggagtacaacggcggcatgaaggaactgatggagcacctgaaagcccagctgcaagccctgtttgaggacgtgagggccatgaggggggccctggacgagcaggcctcgcacatccaggtgctctcggacgacgtgtgcgccaaccagcgagccatcgtctccatgtgccagattatgaccactgcgccccgccagggcggcttgggcgtggtcggcggcaaggggagcttccagagcgacccccaagagccggagactccttcgcctgggatcggggacagcggcttgctgggtcgcgatcccgaggacgaggaggaagaggaagaagagaaggagatgcccagccccgccacaccctccagtcactgtgagcgccccgaaagcccctgtgctggtctccttgggggggacgggccacttgtggagcccctcgacatgcccgacattaccctgctgcaactggagggcgaggcctccctgtgaggggactccgtggggcactaccttcccgggctgtctttgggtttccgagtgcatgacgcgagggggactgaacggcgcggtgcggcatgcttcacttggacagctgctcttgtgggtcaggcagagagagactccctcgaggaaggatttgtagggtgaaggactttgggagcatcgagaattctttctgcccaactaagcgaattatagcgaactgcggaaaggtgaggctccgggagaggaagcgcccatctctggactcccatccatccctatcctgtcctttcccccttcccagacaacaggagaacccgtgaattgtgtaaataaaattctgctttttctattctgaaaaaggacttacctaggaccatggcaaataatctctaacaatttacctggaaattaaggaattgggggtattttgttctggcaacaggaaatttacccttctgctgaaatccaagatattcagtgctctgcagaagcctctccccctcacagatctctgcggctgctgattggtaaaggaagcttgaggagggaactgcagccctaggaatctgggtgaatggggttccaagggcccctgggctgggaggagctggctatgaatgtgcatgaagacataatagctcaacctctaggattttgcatgcagagcggatcctgccttgtcactgacttcatctgggattgcttttccactccctggggcttagagaacaaagagcccggttcacaggcagagactcgggggtgctcagcagcagcccagatttaggggacatttgagggactcttggggccgcagccaaaaactgtctctcctggctacacctgcttaacttcagttcctttttctgtcaatatgtccttgcccactgcctctcggtgttgccttcataatgtcttgtgtgtgttatgtgtgtctacttgtgtagtagtgtgtgagccctcaggggcagggcttgtggctctggtgttaggttcaggggcttcagacccttctacgagctccaagctatcaatggcgcttttctctccctcttcccccaaccagggcatggagcatgtggctgtcctgaggttcttttactgatgtgccgcccttccacctcctcaagtggtgactttgtgtgccctccccctcctttgtgtattccttctcaatgctttccttggtgttaaccttaataaaaaggcgtcatctcccctc

SEQ ID NO: 865 - DNA, 4619 bp, Homo sapiens
gtccaacgccagcaggcttccgggcccggagtgggcggtgggactcggggtcccagagagccgtgcgcgggccgcgacgccgagcaccgccctcgccgtcgcctccgggctttctccggtcgctgccgccaccaccgttgcttcgcgggctgggaggcccggggtccccgggcgaacagaggctgcgggtgggagccttcgcgggcgctgcagagcgggccgggggaggccgggatggagccccgcggagtggactgacgccgcaggggcgagctagccggctccgcgcctctccgcgggatccagacgcctcctggggctgctggcggagggtctgaggcggcgcggccatggctcacctccggggatttgccaaccagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattccggcccacggccaaggagctcctgaagcacaagttcatcacacgctacaccaagaagacctccttcctcacggagctcatcgaccgctataagcgctggaagtcagaggggcatggcgaggagtccagctctgaggactctgacattgatggcgaggcggaggacggggagcagggccccatctggacgttcccccctaccatccggccgagtccacacagcaagcttcacaaggggacggccctgcacagttcacagaagcctgcggagcccgtcaagaggcagccgaggtcccagtgcctgtccacgctggtccggcccgtcttcggagagctcaaagagaagcacaagcagagcggcgggagcgtgggtgcgctggaggagctggagaacgccttcagcctggccgaggagtcctgccccggcatctcagacaagctgatggtgcacctggtggagcgagtgcagaggttttcacacaacagaaaccacctgacatccacccgctgaagcgcactgctgttcagataggggacggaaggtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccacccctgcagtgtgctgttgtgcacgtcagggacgctgttctctatgcccactgccctcctccctctcctggcccagcagtattgctcacgggggctccagccgccggcgtggccctcatgagctacgcctgggtcttctgcagactcatgcagccctatggccgctcagaccaaggcgcagagcaactatcagggcagctctgcctcctcctcccatgaggtggggagaggcaacagggcagcccccagaggagtgtcctggccgctgtcctcccggggcccatgatggccatagatttgccttgtggtgttggatcaggtactgtgtctgctcataagtacttgtgtcatccagaatgttttgttttttaagaaaattgaattacttgtttcctgaaatattctgaggttaatatgttagttttcatagaacattgagaggcccctgccactttcaataaagacctgacttggagacatgcaggtgtgtgtggtggggcccgggccatgcggggctgcagcgtccctggtcccgagtcctcatcacagcacgcagagacggcagcccagccccccttcgaaacttccctgtgacggattcctgggctctgcttggcccaccggaagaacagagcaggcagaggagaatgcaggtggggagatgctgtttgtttatttttaatcaaatgtgtgtgaacaaagcagtcgcccatctacttcccgttggaaggaatgctgggcagtaataaattagacggccccaccctcccagggcacagggggactttggtttctgcttctctagaggtacatggggaacaagcgtggcttctgccagacttgtttagctgtgacctgcagggcaggcccctggggctgccacttggttcaccagatggaaggtcagcatggctgtgccacgcttgtctgagagggtcctggcagtgggtacgcagggtgtatggcagggcctcttttccagtgcttgctctaggccagtcctcggcagggaccctgctctggggagagaggcagggtgtgcccaggctttggtccgatgccgagagcactgctcaggccttgtctgcgtctttgagccaggggcctgggagctgtggcttgagcggctccgcgctcaagactcgcacatttttcccagggccccagatagctgctggcatgcactaggtcctgggtggggggatgaagcccctcccagatgttacatgaggcccacccacactgctggtgccagtggggatccagtgagaccacagccacttcccatctgttgagaagcctcaggacagaggtcacctctgtgtcctgctgttctttgtagttgtgtccaaacctgggcaggttgagcgtcattcctccttccccctgaccatcccctccagccctgaggagggttgggggccatcctgcacgatgcttggggccctcccggctgagctgctggccccctggatcacctccatccacctggaggagagggcggccatcagaccagtgagccatcttgtgctcagacactgtcccaagaacaacccaggatatgggacaagcaggacaaaagaagggttaaaaacctggggccgggtgcggtggctcatgcctataatcccagcactttgggaggctgaggcagatggatcacttgaggtcaggagttcgagaccagcctggccaacatggtgaaaccctgtctctactaaaaatacaaaaattagccaggcggcgtggcgtgcatgcctgtaatctcagttactcaggaggctgaggcagaagaatcgcttgaaccctggaggtgcaggttatagtgagccaagattgtatcactgcactccagcctgagtgacagagggagacgccatctccaaaaaaaaaaaaaacaaagcattgctgttttttggaaatgctggaagcattgctcagcccttcctttccagggcccagaaaacttgcctccaccaccatgagtagaaatgggagctgagcggacatcgaaatgggcagctgaccagggctgcctcctgcaaaattacctttcaaatgtgtacttgctctcagcccggaagaagtagacgtgggatttgaactggagcttgaaaacatagtctttgtgtatgccatcggcctccctggggatgctcacgctgtagcccagcagcgggaggctggccagtgggtagtcatcctgcaagacagcatagggacacgggttccaggggctgggttgccacagggaatgcccattcctctgctacctgcacaacggtggcacgtacaaatgcccacgggccaagggagccagtttccctgttcacacagcacagggtgtgtgggcaaagcatgggagggcagaaccaaaatacaaaagggacacaggtgagcagggttaagtgtctgtctgctagcatcacctgcattgggctccagtgaaactccagtacctgatgagttttgtagaagaacaaacagaagttggtaaagacgacccagagcttctgccagccatgactgtttttgaactttcttagcagatatcctgaaagctggttctgtcaataaaggaaaaatgcaggtgcattaaccagcacccaggaccccttgtgggagtgggtttgctccccaagactaagcctctgcatgctttctccagctgaggccttggttttacctctggactgctatgaacagcagctttatcagtacttaagtccaacagaagcatgttaaaaacctagagtgacattccaggcaccaagtaaagtgagttccctttccctgtgcacaataaagtcagtgttcagtaa

SEQ ID NO: 866 - DNA, 2223 bp, Homo sapiens
ggaaaattacccggtatcgttagagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaatagccctgatactgccaacgatggcttcgtccggcttagaggactcccatttggctgtagcaaggaagagattgttcagttcttttcagggttggaaattgtgccaaatgggatgacactgccagtggactttcaggggcgaagcacaggggaagcctttgtgcagtttgcttcacaggagatagctgagaaggccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatgaaaatctgaggctttggtttaaatctttccttgtattgtgatttccatttagatgtattgtactaagtgaaacttgttaaataaatcttccttttaaaaactggaaaaaa

SEQ ID NO: 867 - DNA, 1468 bp, Homo sapiens
aagatggcggctgccgcggagtgcgatgtggtaatggcggcgaccgagccggagctgctcgacgaccaagaggcgaagagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagtt

SEQ ID NO: 868 - DNA, 1948 bp, Homo sapiens
agggaagttctcactggacaaaagcgtggtctctggcgcggggatctcagagtttcccgggcactcaccgtgtgtagttggcatctccgcgcgtccggacacccgatcccagcatccctgcctgcaggactgttcgtgttcagctcgcgtcctgcagctgtccgaggtgctccagttggaggctgaggttcccgggctctgtagctgagtgggcggcggcaccggcggagatgcctgggaagaaggcgcgcaagaacgctcaaccgagccccgcgcgggctccagcagagctggaagtcgagtgtgctactcaactcaggagatttggagacaaactgaacttccggcagaaacttctgaatctgatatccaaactcttctgctcaggaacctgactgcatcaaaaacttgcatgaggggactccttcaaaagagttttctcaggaggtgcacgtttcatcaatttgaagaaagactgcattgtaattgagaggaatgtgaaggtgcattcatgggtgcccttggaaacggaagatggaatacatcaaagtgaatttctgttcaagttttcccagattatcattctttgggatgagagaacattataaaaccactttgtttattttaaagcaagaatggaagacccttgaaaataaagaagtaattattgacacatttcttttttacttagagaatcgttctagtgtttttgccgaagattaccgctggcctactgtgaagggagatgacctgtgattagactgggcggctggggagaaacagttcagtgcattgttgttgttgctgtttttggtgttttgcttttcagtgccaactcagcacattgtatatgattcggtttatacatattaccttgttataatgaaaaaactcattctgagaacactgaaatgttatactcagtgttgatttcttcggtcactacacaacgtaaaatcatttgtttcttttgactcaaattgtattgcttctgttcagatgatctttcattcaatgtgttcctgttgggcgttactagaaactatggaaaactggaaaataactttgaaaaaattggataaagtataggagggttacttggggccagtaaatcagtagactgaacattcaatataataaaagaacatggggattttgtataaccagggataataaaaagaaaaaagaagttaatttttaattgatgtttttgaaacttagtagaacaaatattcagaagtaacttgataagatatgaatgtttctaaagaagtttctaaaggttcggaaaatgctccttgtcacattagtgtgcatcctacaaaaagtgatctcttaatgtaaattaagaatattttcataattggaatatacttttcttaaaaaaaaggaacagttagttctcatctagaatgaaagttccatatatgcattggtgaatatatatgtatacacatacttacatacttatatgggtatctgtatagataatttgtattagagtattatatagcttcttagtagggtctcaagtaagtttcattttttttatctgggctatatacagtcctcaaataaataatgtcttgattttatttcagcaggaataattttatttattttgcctatttataattaaagtatttttctttagtttgaaaatgtgtattaaagttacatttttgagttacaagagtcttataactacttgaatttttagttaaaatgtcttaatgtaggttgtagtcactttagatggaaaattacctcacatctgttttcttcagtattacttaagattgtttatttagtggtagagagttttttttttcagcctagaggcagctattttaccatctggtatttatggtctaatttgtatttaaacatatgcacacatataaaagttgatactgtggcagtaaactattaaaagttttcactgttc

SEQ ID NO: 869 - DNA, 2112 bp, Homo sapiens
gcagactgccataagatggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcagaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttacaaga

SEQ ID NO: 870 - DNA, 839 bp, Homo sapiens
atcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatcagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaa

SEQ ID NO: 871 - DNA, 999 bp, Homo sapiens
gcggctcccaggaggcgtgaaccgcggaccatgagcgtgggcttcatcggggccggccagctggccatgctctggcgcggggcttcacggccgcagcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagcccatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatgcattcatggctctggacgcattggctgatggtggggtgaagatgggtttgccacggcgcctggcaatccaactcggggcccaggctttgctgggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatc

SEQ ID NO: 872 - DNA, 1536 bp, Homo sapiens
ggaactcgccgggccacaccccctgtccagggaaggaacacgcccccggtgacagccggtacggccccgggtttgggcaacctcgattacgggcggcctccagccccgccagcagcgccccgcgcccgcccgcccgcgcccctgccgccccccggttccggccgcggaccccactctctgccgttccggctgcggctccgctgccggtagcgccgtcccccgggaccacccttcggctggcgccctcccatgctctcggccacccggagggcttgccagctcctcctcctccacagcctctttcccgtcccgaggatgggcaactcggcctcgaacatcgtcagcccccaggaggccttgccgggccggaaggaacagacccctgtagcggccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggttctttcagagcacggcttcggccccatcactaccgacatccgggagggacagactttctactatgcggaagactaccaccagcagtacctgagcaagaaccccaatggctactgcggccttgggggcaccggcgtgtcctgcccagtgggtattaaaaaataatttctccccacatggtgggcctttgaggttccagtaaaaatgctttcaacaaattgggcaatgcttgtgtgattcacaatcgtggcatttaaagtgcacaaagtacaaaggaatttatacagattgggtttaccgaagtataatctataggaggcgcgatggcaagttgataaaatgtgacttatctcctaataagttatggtgggagtggagctgtgcagtttcctgtgtcttctggggtctgagtgaagatagcagggatgctgtgttcacccttcttggtagaagctaaggtgtgagctgggaggttgctggacaggatgggggaccccagaagtcctttatctgtgctctctgcccgccagtgccttacaatttgcaaacgtgtatagcctcagtgactcattcgctgaaatccttcgctttaccaaatctagacatacataaggggctttctctcccttttcagccctctctgtgcagagaaaagatgtgagtccgcttgatgaattctaatgctttgcttagagctatgagaaatgtttgttttaataaaaacctacagtccaataatgccaa

SEQ ID NO: 873 - DNA, 4688 bp, Homo sapiens
attatgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggcctagccccaggcccagcccccagcccagcccccagccccacagtagcccctgacccagccccagacgcctaccgtccagtggggctgaccaaggccgtgctgtccctgcacacacagaaggaagagcaagccttcctcagccgcttccgagacctgggcaggctgcgtggactcgacagctcttccacagctccctcagcccttggcgagcgaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctcgccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaat

SEQ ID NO: 874 - DNA, 2381 bp, Homo sapiens
gaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggcctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctgcctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtgatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagcttagattcccatgtagaattactgagtcaaagaatatgaacattttgattgttcttgatatgctttgctacatttcttctgaaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaattt

SEQ ID NO: 875 - DNA, 2186 bp, Homo sapiens
ggtttgggaggcccaggcggcggagcctccgggacggcgagcggcgggcggcggaggaggagacggcaggtcgggcattaaaaaatatttaatcattcatgtgttgagactcattcttgagttatggatgacaaggcttctgttggaaaaatcagtgtctcttcagactcagtatctactcttaatagtgaagattttgtcttggtttccaggcaaggagatgagacaccatctacaaataatggaagtgatgatgagaaaacaggactcaagattgtagggaatggaagtgaacagcagctgcaaaaagagctagcagatgtactgatggatcctccaatggacgaccagccaggggaaaaggagcttgtgaaaaggtcacaactggatggtgaaggagatgggcctctttctaatcagctctccgcttcatccaccattaaccctgtgccattagtagggctccaaaaaccagagatgagcctaccagtgaaacctggacaaggagattctgaagcttcaagtcctttcacaccagtggccgatgaggacagcgtagttttcagtaaactgacttacttaggctgtgcctcggtaaatgctcccaggagtgaagtggaagccttaaggatgatgtccatcttaagaagccagtgtcagatttcactagatgttaccctttcagtgccgaatgtgtctgaaggaattgtgagactcttagatcctcagacaaacactgaaatagcaaactaccctatctacaaaatcctcttctgtgtcagagggcatgatggaactcctgagagtgactgttttgctttcactgaaagtcattacaatgcagagctcttcagaatacacgtcttccggtgtgaaatacaagaagctgtaagtcctcaagagaaaactctctgcaaatgaaacttcaccagtgccctcactaggttgaaatgattatggtatttattatgatcactcataagccagatgaaattctctgctattgttttagtgattctagcctcatgggccaaaatataaattaactaaaaatttgattaactagaactttgttactactactaagaatgtcagaggagatctgttggctacttttgattgggttaagtaggcattctggttctaacattgacagatttgcaaaccattcttttaaatcaaaacttgttaggactgttttcattgtaatatcttcagatagtttctaacaatttaggaagtgatttttaaattggatttatagtgcttacaaccatttcttttttaaaaccccttgtctggacatttttagtgttgcttgctttataggcctaacaaattaggtaatttaccaaaagaaataagtgggataaagataattattgccctccaaagtaggtaatcttccagccttaataaaggtattttatatcttttgataacagcccatttcctaacatgtctggttgtaggtaagccggatactttacagttttgccactgccttccgccgttctgccaagcagaccccactttcagccactgctgcaccccagactcctgacagtgacatctttaccttctctgtgtctttagaaataaaagaagatgatggtaaaggttattttaggtagggaatcttattttattcatgtattaacatgctgtggttcaggggaaattctaggtcagattataactttcataccataaaatgatggcttttaaagggagggcttttaaaaaaaatctggatgataaaggcatataaatacataaatttaacagaggcaaagtttgaagaattttaaagcaattaaaaaaattgtcatattgggaacatgttgctaccttcttttagtcagataccaagtggctaactgctcacaaaaatatggccaaaccgccaggcgctgtggctcacacctgtaatcccagctctttgggtggctgaggcggacggatcacctgaggtcgggagttcgagatgagcctgaccaacatggagaaaccttgtctctactaaaaatacaaaattagccgggcgtggtggtgggtgcctgtaatcccagctacttgggaggctgaggcaggagaatcgcttgaacccggcaggcagaggttgcagtgagccgagatcctgccactgcactccagcctgggcaacgagaacgaaactccgtctc

SEQ ID NO: 876 - DNA, 1310 bp, Homo sapiens
attagctgacatcaggaactgagccaggcagtgtggttgtgatgtcactatctcacctcacccccacctaagagattgtggtggggaatctcagacactctaaccctctgggcccaagtcacctttctatcaggggagggaggctgtgctctcactggcttcttgttagaagttctgcctgccctacagcctgcactgagggctctcatcactgcttctgagatcttaatgggggtcaacgaagatgtgggcttctctgagtttagaccatccatctgccaaggaaaaccaagccctgagactgatagagatgagagaagagaatggtaatgtccccaagacagagcaggcaggaagtttgaagcctctgagggatacaggaaaatctaacctcaaagagaagaaggccaacagcaagctgaagcagattgagaaggaatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgaccaagcaatcaaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattcatacactagtggggtggttttatttgtgtctgcctaagttatttttttaacattcctttatttccgattttcatgtttgtgtgcatttgagtatgtgctgagaactgcttatattgggcaaagtgatttcctatgatatgccttgttaatccttttgcatagaattttaccagttgcgtacgatcaaaatcacgtttgtagtatcatatcaaaaattctaacctgtttacattgttttcatgttcatgttcctatgttattaaaatattattttgtactt

SEQ ID NO: 877 - DNA, 2615 bp, Homo sapiens
gaacactcatcagtgcgcaggcgcccatcttagttggtcttctagtccggtaaacagagggcctgcccccgacagcttctgcttccgggtcacgccttgacagcggctttcaacccccacctcagcccagcaattcggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggcctctgtcaatgccctggattacaacaatgatacaccgctcagctgggctgccatgaagggaaatcttgagagtgtcagcatccttctggattatggcgcagaggtcagagtcatcaacctaataggccagacacccatctcccgcctggtggctctgctagtcaggggacttggaacagagaaagaggactcttgctttgagctcctccacagagctgttggacactttgaattgaggaaaaatggcaccatgccacgagaggtggccagagacccgcagctatgtgaaaaactgactgttctgtgctcagctccaggaactctaaaaacactcgctcgctatgccgtgcgccgtagcctgggactccagtatctccccgatgcagtgaagggccttccactgccagcttctttgaaggaatacctgttacttttagaatagccggagaagatgtttgcaccatcgtgcaggcagctctgggtgaggttgtccctgcagtactccttgtcacagaaaacagaaaaacagttgttcctgttgtgtggtttatagatttcgaagcaacatgtcacaacaataacctccatagcacctccccttcccaaaccaaacaacccaacaaaaaaaatccctcacttttgttttctgtttattgcttacctggctttttatattgcattttgcaaaagaagaggtctccctcaatcctcccctttagggaaggagtcaacagtgtaactaaatttctctaggaagatggaaagtacttaaataatgtgtgtgtggttttcctttggggacgtggttaacggtccagaagaatcccttctagaaagcattttaggccagccatggtggctcacgtctgtaatcccaggactttgggaggctgaggcaggtggatcacctgaggtcaggagttcgagcccagcctgaccaatatgatgaaaccccgtctctactaaaaatacaaaaattagctgggcatggtggcatgcgcctgtaatcccagctactcaggaggctgagacagaagaatcgcttgaacctgtgaggcagaggttgcagtgagccaagatcgcgccattgcactccagcctggacaacaagagcaaaactgtctcaaaaaaaaaaaaaaaaaaaaaaaaccattttaattgatctgtgaaaaaacttaagaaaatcacaatttcagctaacagcaattgtgtcccaaagatgaagatactataacctcaaatggtgcagatccagaactgggctggatgacatccctactgtgccatgtcctggggcatttggaagggactggacctctttcccctcatcaaaggaaacagcagtctttgcctctttctgttggttgtgcccaagggctacagtagctctgaaataacaagagctctgtaataacagtaataaatagctctgaaataacagtcctaagaactcctaaagtcctgagaacttttcttgtaatgcagctttttctcttcctgagaaacagtgtgttctaatgggattcccaggcagttcctacacctacggtgtgtgttccagcagggaggagttatgggctgggctgccttttcccatgggtcttcattcccaatggaaagttcactctgcttagtttggaattatttttctttcagttgttctggaacctttgctttttattgatttatacaatacaattggtgggagggtggacttgggatgggagtgggaaaagcatgtaagagctccttttgtgatggtccatctacccaaaagagatctgctttagtgaacgatactctttcatttttctaaattagatcaagttgttattgattttagatgacttgtatgcaaatttgaaaaacttttttttttaaagctgattgggaactacaaacaatgaatggaatctactgacacagctaattggaaaacagatgtcttcttctgtcctattgatgctggtgtttaaaaaacatcacttaaaaaaaaagaataaatagttctaaaagcaag

SEQ ID NO: 878 - DNA, 2002 bp, Homo sapiens
ctcccggcaagggtcccccgactggcgcccgcgcgtcctccctcggctgctgcaggccgggccgcggcgtcgagcgggggcggcggggcggggcccgcagccattggcgagcggcggggcgggggcgggggcgcggagggtcggccccgggacgcgcgcagccggcccgcagttgccgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttggccagacgggtgcagggaacaactgggcgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcggtgcaccagctggtggagaatacagacgagacctactgcatcgacaacgaggcgctctatgacatctgcttccgcactctgaagctgacaacgcccacctacggggacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgccaggaacatgatggccgcctgcgatccgcgccatggccgctacctgaccgtggccaccgtgttccgcgggcccatgtccatgaaggaggtggacgagcagatgctggccatccagagtaagaacagcagctacttcgtggagtggattcccaacaacgtgaaggtggccgtgtgcgacatcccgccccgcggcctgaagatggcctccaccttcatcggcaacagcacggccatccaggagctgttcaagcgcatctccgagcagttctcagccatgttccggcgcaaggccttcctgcactggttcacgggtgagggcatggatgaaatggagttcaccgaggcggagagcaacatgaacgacctggtatccgagtaccagcagtaccaggatgccaccgccaatgacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttca

SEQ ID NO: 879 - DNA, 1930 bp, Homo sapiens
aggtcaacatcagcacccaagagctttgggaggaaatgctcagttccaaaggactaactgttgttgatgtctatcaaggctggtgtggcccctgcaaacctgtggtgagcctcttccagaagatgaggatcgaggtcggcctggaccttctgcactttgcattagcagaggcagatcgtcttgatgtcctcgaaaagtacagagggaagtgcgagccaacctttctgttttatgcaattaaagatgaggctctttctgatgaagatgaatgtgtttcccatggaaagaataatggtgaagatgaggacatggtttcatcagagaggacctgtaccttggccatcattaaaccagatgcagtggcccatggaaagactgatgagattatcatgaagattcaggaagctgggtttgaaattctaacaaatgaagagagaaccatgacagaggcagaagtgcgacttttctaccaacacaaagctggagaggaggcatttgagaagctggtacatcacatgtgcagtggaccaagccacctcctgatcctcaccaggactgagggcttcgaggacgtggtcactacctggcgaaccgtcatgggcccccgtgaccccaatgtggccaggagggagcagccagaaagtctccgagctcagtacggcacagaaatgcccttcaatgccgtccatggaagccgggacagagaagatgctgacagagaactggcattgctcttccccagtttgaaattttcagacaaagatacagaagcccctcagggtgagtccagtacacagccaaggttgaagatcactgacctagactaaaatgagaggattcagaagtctgaccttagaacatgagagagtggaaaacctcaggatgtttcagccaaacaagaagagaagaaaatattgttgaaattaacaatgatcagggaaaatatcatctattaagaacagggaaccacattttagctgtagattaggaatggtaatttttatctggtgttttagtttccaaaacatttacatattgatctactcctcgccctagaccaaacctaattccattcttactgatatgcacaatcactctctgtcctcattgtcacctctagcccctaaattcctccctttctcagtctacctactctttgtgactccctcatatcttttccccctggcatggatgtcctgctcagacactccacttagaagacagtttccctttttcactgtcctcccaccattcattactcctcctccagataccaactgctgatgttgctctagaaaaaccaccaaacatgactgttctttccgtgtaagctatcccacctcagcggcaccctcactgctggtgaccagccttgtaaccccctggagatgcccatgttccttatggtagctacctcttacttcaaattcttctgcctccctcatgctcgcagccactctgtgcccacctcatcttcgtagggaccttgattttggggacacacattgcaacttcccacttctgacgaaaggtctccatgcttttgctgttttctttactcttgtcaaggttgggtacttcaagctcaaagcctatctaccttgatccaaaaactacctttccataatgttctcacatctttactctgtcctacctctcattttcaatcctgtttaaaagacgtttaagtgtccaaactttaacctcttgaagctagtcctctccccactttccatctttaaatgggcatatatacaataaaggctctgtccatctccatctcttatatataacaatactgtgacttaaaaaccaactcagtattggaaattttctaaagttctgtcctagagttctttcctgacctctagctccatacttctgattgcctaataaatatgacatggatgttcagtggaacttcccatct

SEQ ID NO: 880 - DNA, 1682 bp, Homo sapiens
ggcagacgtccctgggttccggtgttcgcggaggagtcgagcagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatcaaaaaa

SEQ ID NO: 881 - DNA, 600 bp, Homo sapiens
gcggccgcgggcaccagagtgccgagcccaggacgcccccggcccaggcccttgggttaatacctctgccaaccgaggccaccctccctcggacccccattcggaggaagcagacccaagttcgaattctgacattgccactgagcagccgtacaacttttgggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaa

SEQ ID NO: 882 - DNA, 3671 bp, Homo sapiens
ggttaagagagacgcgcgcgcagtcgcgcgcgggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacatacaaaagcttttgatgactggtaactggtatccttccaaataaatgcattgcttggtaacaaatgttagcttaattcagaatgaaatagttaacaaccctaatattgtaaaatttgaaaactgatagcagctgtcatttataacaattcttgggctgtttaaagggtacatttgactatagctaaggaaattgaatctcactttaaaaatgaaccacacaaaacttcaagaaacgaaatagaaatcaacatttactgcccgtaatattgctcatggttatagctagtatcacatagtgatttacaaaccatgaaattccagatttaaatctgttgcactacaaaaatgtctaaatgatgtctgctaaatttgtgagttatagaagtacagaaataagtcattttcatttcaaatgcagtgaatttctaatttcatggtatcatatttttttcctttgcagttttggtaagactcccccattactttgctaagacttgctttctcaaccagtgggatgaaacgagtgccagtgtgttgactgagccttcttaggacttaaggggctctgggagaggccaaggcagcagttgaaaactgcagcttcacctggcctttgggcctgttttccctggcccacacagtgtggctggttaaaacattctgaatttgatgccaacatttttaaaaattgggagatttgcatgaaaatccagaattcgggtaacttttgaatgatctgaagatctggcaacagtagacctgacccacctttgtgcacgggacttaactgagaggatctgagtagcagacaccctaagagcatgtcattgtcttctcaccagttactctccagttggctagagtcccctccgagcacacctgctagtccttcccccttgtaagcctttgactttgtaatccctgggctaaaggaaacacattattcaacaaaagtgtttcatgtttgcccactagttgttggggatgattaggtggtgagtgaatggcatggggctttcctttggggaccatatactctaatggggaagggggacagacaaatagttgtaactctgtcatggaaaagagaagtaacttggacagacttttggattcaggccagatgaacatctccaggcagagggaacagcagcatctgcaaagtc

SEQ ID NO: 883 - DNA, 3432 bp, Homo sapiens
ctgcggcggcgcgctccgagcctgcgtctagggcgcccccgggtcagagctgtcgccgtggccgccgctgcaagaaccatgtaccgcagcagcgctcgctcctccgtctcttcccaccggcctaaagacgacggcgggggcggcccgcgcagcggccgcagctctggctcctcctcaggcccggctcgccgcagctcaccgccgcctccgccctccggctcctcgtcgcggaccccggctcgccgaccccgctcgccctcagggcaccgcggccgccgggcctcgccgtccccgccacggggtcgtcgcgtctccccgtccccgcctcgggcccgtcgcggctccccgtcgccaccgcggggccgacgactcttcccgccgggcccggccggcttcagaggcagcagccggggggagtcccgcgccgactatgcccgggacggccgcggagaccatccaggcgacagcggcagccggagacgctctcctggtctgtgttctgactctttggaaaagagcttaaggatcactgttggcaatgaccacttctgtgttagcacaccagaacggcgacggcttagtgatcggctggggtcaccagtggataatctggaagacatggacagggatgacctgactgatgattctgtcttcactcgaagctcccagtgctctcggggtcttgagcgatatatttcccaggaggaagggcctctcagtcccttcttgggacaacttgatgaggactaccgaacaaaagaaactttcctgcatcgatctgattatagtccccatatcagttgtcatgatgagctgttgcggggaacagaacggaatcgagaaaaactcaaaggctactccatacgatctgaagaaaggagccgggaggccaaaagaccccgttatgatgacacagtgaagataaacagcatgggaggggatcacccaagttttacatcaggaactcgcaactatcgacagcgtagaagaagcccaagtcctaggtttctcgaccctgagtttcgagaactggatcttgccagacgaaagcgagaggaagaggaggagcgaagtaggagcttgagtcaggagctggttggagttgatggtggtggtactggctgttccatccctggattgtcaggtgtcctaacagcatcggagccaggatattctttgcatcggcctgaggaagtatctgtgatgcccaagaaatccattttgaagaagcggattgaggtggacataatggagccctccatgcagcttgagagtttttccagcagtaccagctccagccaggatcaccctctctactctgggcacccatcccttccactaagtggtgctattgctgcttttgcctcagagattgaaaacaaggggactatggtagagactgccttgaaggaacctcagggcaacctctaccaatggggtccccttcctgggattcccaaagacaacagtcctctcagagaaaaatttggaagttttctatgccacaaggataatttggatttgaaggctgagggacctgagcgacacacagacttcctgctgccccatgagagagctagccaggatggcagtggtttttcccgcattctgagcatgttggctgattctaccagtacacaggaaaaaaggcgacgtagctttcccgacattgaagatgaggagaaatttctctatggggatgaagaagaggatttaaaggcagaatccgtaccaaagccccttgggagctctgagagtgaagttatgaggcagaaggcaagctccctgccgtcttcagctccagctgtaaagctagaatcactagaagagaccaatccagaatatgcgaagatccatgacttgctcaagacaatagggctggatattggagtagcagagattagtcaattggctgcacgcacccaggaacgacttcatggcaagaagccatcattacgctcctcagctgaccgccgttcctcagttgaccgatacttttcagctgaccactgttcctcagttgaccaccgcttctcagctgaccgctgttcctcagttgaccactgcttctcagctgatcgacgttcctcagatccccacagactagagagcagggaggcacatcatagcaatacccactctccagaggtgtcccatccacacccaccttctcctgtggatccttacctgctcacaaaaaacagccctccattcctaaagtctgaccatccagtgggtcatatttcaggaccagaggtggttggtagtgggtttcagtcatctgttgcagtcaggtgcatgttgccatcagccccatctgccccaattagacttccacacactgctgctttatctcagtttcacatgccaagggcctctcagtttgctgcagctcggatacctccgaactaccagggacctgccattccccctgcctcttttgatgcctataggcactacatggcatatgcagcctccagatggcccatgtatcccacctctcaaccgtcaaaccaccctgtacctgaaccacacaggataatgccaataaccaaacaagctactcgtagccgtcccaatcttcgtgtgatccccactgtgactcctgataagcctaagcagaaagagtctctgcgaggctcaattcctgcggcccaagtgcctgtccaggtgtccattccatcactcataagatataatccagagaagatctctgatgagaagaaccgtgcttcccagaagcaaaaggttattgaagagagggaaaaactaaagaatgaccgggaagcccgccagaagaagatgtactatcttaggaccgagttagagcggcttcataaacaacaaggagaaatgctgcgcaagaaacgaagggagaaggatggccacaaagatcctctcttggtggaggtgagtcggcttcaggataacattatgaaggacattgcagagctacggcaagaggcagaagaggcagaaaagaagcaatctgaactggacaaagtggctcagatcttgggaattaacatcttcgataaatcccagaagtctttaagtgacagtagagagcctacagagaagcctgggaaagcagaaaaatctaagagcccagaaaaagtgtcatcgttctcaaactcctcctccaacaaggaatcaaaagtaaacaatgagaagtttcgtactaagagccccaagcctgccgaaagcccccagtcagccactaagcagttggatcagcccactgctgcttatgagtattatgatgctggcaatcactggtgcaaagactgcaacaccatctgtgggaccatgtttgatttcttcactcatatgcacaataagaagcacacacaggggcaattccaaaagtcttcagatttccaaaaggaaggactgcagcagacatttctgcccccagaaaggcagggatag

SEQ ID NO: 884 - DNA, 2394 bp, Homo sapiens
gatctcagttttatcatgaatgacttctccattgtgattcttgatttccttcatgggttaatttagaggttatgtatgtatgtctgtgtgtgtctgttgctaaggtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcgggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaaactgccttttacaagttagaaaatgctgtttgaatctagttgaaccagggaatacagagcgagcaatatgtagcttgaattacatttaaaagcagattttttacaaacaaaatggcgaaagcactgattgtcatttttagcagtcacttaaggcctatagaacttttttcaagtcggaaggtcctgttcttactatctcaaaaatgggcatcgaacaatcaatctaggagcgtggcagtgggtaaaatggtggacaggcaccaaagctattttctcatctgtcctgtggatgagtggaactgtggaacaagtgatgtggaattaatgggtgcaacagctgtacagacaatcaataacacacacagttctggaaagaacacatcacttgtgcttgtttgatgagcttgtcacattctaatccctctccccatcctgtttcaattttgggaaacttgtatctgctggtgtcagcaattctgattctgaaataggatcaggcttttactacaacagccttctctttctatttattgtgtcgactcgtggcttatgaataaaggcaggcaaagtttgcagaactgtcttaaggacatttattttttttccctttttaagtaattttacactttagtatctatttcagagtcatatttaaaactatttattagtgactacagtacatgagacaacaaggttactgagattacaattcttcaaaggttaatgataatgtggtttatactgtgccttaatagtaatgctatttaagatatttatttttaagttttactatgctgcactctaaagaaaggaactttagatgtgacactgtaaaattatgtattcatctcatggcataaattatttagtaagtctagatgtagcgtattaaatattaacctattcaactaaagatgttgacttggatttatttaaattcatatgtgcactgtataagagagtactcttacattaacacattttagtttagtttttagatttttttttaaacgatatattgctagtttcatgcttcctcctctgattttgcctgtgtagatttcatttattggtaattcattagtttaacactattatgtagtttttaaatgctgctttacatttttcttctgaaactgcaatacttgcaatttttattcttaaactaaattgaatactattttacactgtattggatttttatacttgaacaatttcatacaagggaagacaggttagcatttttatggactttctccattatcactggatttactttaagtattcccatactagacagtgttatgtaatgtagacatgactctcctgtgcaaattatttattcgttgtgtatattgctttataacatttcagatcttctaatctattcacttgtattaaatataattttt

SEQ ID NO: 885 - DNA, 626 bp, Homo sapiens
gggcgggccagggccgcactccggagactcgcggttgctacgcgcaccatggctggagcgcccacggtctcgcttcctgaactccgttcactcctagcctccggacgggcccggctcttcgacgtgcgctctcgcgaggaggcggcagctgggaccatcccaggggcgctcaacatcccggtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactgggtacggggaggtgtggctgctagctgggaggtgatggggactgcctgtcattcctgtcagtctctcacgcttctttgtctccacagggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaa

SEQ ID NO: 886 - DNA, 2145 bp, Homo sapiens
ccggagcctgcggcgggcggctgtgacggccccggcgctgacggcggcggccgggggggcggtgtcgacgcccgcggcgccggctggggcatcaccgcgggcctcgaccccgaaatggcgctgctggccgaacacttgctgaagccgctgcccgcggacaagcagatcgagaccgggcccttcctcgaggcggtgtcccacctgccgcccttcttcgattgccttgggtccccagtgtttactcccatcaaggcagacataagcggcaacatcacgaaaatcaaagctgtgtacgacaccaacccagccaagttccggaccctgcagaacatcctggaggtggagaaagaaatgtatggagcagagtggcccaaagtaggggccacactggcgctgatgtggctgaaaagaggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggaggaggagtgcctggagaagatccgcctcttcctagtcaactacacggcgaccatcgatgtcatctacgagatgtacacccagatgaacgctgagcttaactacaaggtgtaggcatgcccactgctggacacgtccccgactcgtggccacatggagaaacaggcaaaccagaatcactgtgaatcaagtcggtgaactgcccctggcctgtgtcccccagagcagcccagggtcctgccagagtctgcaggggacagccctcgttttttaagtcttttttttttttttttttggtctattctaaaggaccagtaaataatgatcttacttccaaatctccttggaatttcacgacagcacagactgactttataccttcatttcagcgtggtaaaaaccgattaacacttctaatgagtcaagtcctagggttttttggttttgttttgttgccaacgaggaacacagctctgggggaatggtgtcatccacctcgctttaaaaataagcacatgatggctgggcaccgtggctcacgcctgtaatcccagcactttgggaggctgaggcgggtggatcacctgaggtcgggagtttgagaccagcctggccaacatggtgaaaccccatcgctactaaaaatataaaaaattagctgggcatggtggcgcacgcctgtagttccagctactcaggaggctgaggcaggagaatcgcttgaacccgggaggtggaggttgcagtgagctgagatcgcaccattgcactccagcctgggcaacaagagcgaaactctgtctcaaaaaaaaaaaaaagaggtgggtggattacttgaggtcagggtttgagatcagcctgaccaacatggtgaaaccctatctctactaaaaatatagaattagccaggcatggtagcgcacgcctgtaatcccatcttcttgggaggctgaggcaggagaatcgctagaaactgggaggtggaggttacagtagccgagatcgcgccactgcattccagcctgggcaacaaaagcgaaactctgtctcaaaaaagaaaaaaaagaaaaaaaagcacgtgaccttatgaggctctcgctgtattgttattttaaggactataaagagtttgatttaaaattatgcagggcccctatgtgggattttttaaaaagcaaactggtgtgtattctcatgtggtttgcacagcccagcctcacagcactattgtaaaccctgctctttctgtctcgctagacagatttttttgtttgttttcttttttctggttgttttttgttgttgttgttgttgttttacagctgaaaccaaccagcaagcccttgatgaccaagaggcgtttctttcaaagctatagggcacaaacaattgaccatagatgactccgtttgcattcttctgcagaattatttccttcagggacagattttccaacctaagaaactacctaccgtgtgtattctcttgacggggagagatgaacccttcagctgc

SEQ ID NO: 887 - DNA, 1456 bp, Homo sapiens
ctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacagggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggtcagacccaactcaggccttggtgtccctggactgcaagtgtggaaggagggaaagcctggtttacctctctctgcatctgagctctgctacccatggagcagatggatggtgggaacaggaaagagcttatgttacacctcattcccatgcttagcccacccagagctaacccctgtcttcttccccaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggtta

SEQ ID NO: 888 - DNA, 2650 bp, Homo sapiens
agaaggccaagccccaagcccagcctctcgccagctgggagtcgcgcgctgcccacctcgctgcccaggcccccgacgccgcggcaggagccccccaagagcgcgggaagccccgtggacctggcgctcccggctcgggcgtggacggggcgggcgccggggcggggcgcgcgtcctcgcgggtctgaatggaagggtcgaggtcgtcgtcggcggcgagcagatcctgaagccagaactccaccccggcgcccgcgccatgcggcgggagaggtgcggcgccccccacccgcgtcgccgccatggaggtgctgcggcgctcctcggtcttcgccgccgagatcatggacgcctttgaccgctcgcccacagacaaggagctggtggcccaggccaaggcgctgggccgggagtacgtgcacgcgcggctgctgcgcgccggcctctcctggagcgcgcccgagcgtgccgcgccggtcccgggacgcctggctgaggtgtgcgcggtgctgctgcgcctgggcgatgagctggagatgatccggcccagcgtctaccgcaacgtggcgcgtcagctgcacatctccctgcagtctgagcctgtggtgaccgatgcgttcctggccgtggctggccacatcttctctgcaggcatcacgtggggcaaggtggtgtccctgtatgcggtggccgcggggctggccgtggactgtgtgaggcaggcccagcctgccatggtccacgccctcgtggactgcctgggggagttcgtgcgcaagaccctggcaacctggctgcggagacgcggcggatggactgatgtcctcaagtgtgtggtcagcacagaccctggcctccgctcccactggctggtggctgcactctgcagcttcggccgcttcctgaaggctgccttcttcgtgctgctgccagagagatgagctgcccacctggcagtggccgcagcctggccctctgggcccaacgcaggaggccctcagcacccgaacacatcttcctcctccccacccgagcctggagcactctaaccctcggagaccccctaagccccgttcctccgcagacccaggccctccggaaggggtgagtggggaggggctttcctgagcctggagctgggctttggggcagcctgcgaccctccccgcttgtgtcccttctcctgtgatctctgtgttttcccttttctttctggggccaggaagtcagggtcaactcccaggcctcagatgcaggggcccagaacacctgctctcacctgagccccaggtgaaggggcccgggaacacctgctctcacctgagccccaggtgaaggggcccgggaacacctgctctcacctgaaccccaggtgaaggggcccggaacacctgctctcacctgagccccaggtgaaggggcccggaacacctgctctcacctgagccccaggtgaaggggcccgggaacacctgctctcacctgagccccaggtgaaggggcccgggaacacctgctctcacctgaaccccaggtgaaggggcccagaacacctgctctcacctgagccccaggtgaaggggcccggaacacctgctctcacctgagccccaggtgaaggggcccgggaacacctgctctcacctgagcccctggtgaaggggcccggaacacttgctctcacctgagccccaggtgaaggggcccggaacacctgctctcacctgagcccccggtgaaggggcccggaacacttgctctcacctgagccccaggtgaaggggcccggaacacctcctctcacctgagccccaggtgaaggggcccggaacacctcctgtcacctgagccccaggtgaaggggcccgggaacacctctcacctgaacccgggggtcccatcccaggaagaagggccatctcaggacatgagtcctcaggggccctgcacattcaatctgaaggtgaccctggcctggctgaagctggaagagctgtggggactcagcctgtaaacagagcgtaaggttcacatgctggttgcttaatccgtttctggaggaagagtatgacacccacttgtgatggggtccttgtgcggtggggaccggggccggcgggctccaggccagcacacctaacccatggatgtggaacctacggccgagaaggaatgttgcatgagtcggatcccagtccattgtcagtggagggtgagggtgaccccatctgctatttttgtgctcatcctcatacaaccatttggggatgtgcctattagggctccgtaagaactcagatgcctgggaagcccagcccctcaggtgcccccacacacagccttcccttgacgcctacatttctaggcacatgtgaggcatctttcctggagccccgagccagccctgtccctccccagtgcagcatggcactcaggagatacaggctggacatggggcagtcgttctggggaggcctggcctagcagccacccacctgagccctcccggccaggcttcgtgctggggtgggccatgtgccaggacaggagggtcccggcggaaagccagccccggactcatcgtgacattgagatcccactggagggtaggggtggtaataaacttctccaaacgatcgttgtcatttta

SEQ ID NO: 889 - DNA, 3148 bp, Homo sapiens
tcgggtgactccgcaacctgtcgctcaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcaggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgctgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccagga

SEQ ID NO: 890 - DNA, 2111 bp, Homo sapiens
cgggagcggggcggcgggcgccggggctggcatggcgtggccctgtatcagccgcctgtgctgcctggcgcggcgctggaaccagctggaccgctccgacgtggcggtgccgctcactctgcacggctactcggacctcgacagcgaggagccgggcacgggcggcgccgcctcgcgcaggggccagcctcccgcgggcgcccgggattccggccgggacgtgccgctcactcagtaccagcgggacttcggcttgtggaccacgcccgccgggcccaaggatccgccgccggggcgcggaccgggggcgggcggccgcaggggcaaatcctccgcgcagtcctccgcgccacctgcgcccggcgcccgcggggtctacgtgctgcccatcggcgacgcggacgcggctgcagcagtgaccacgtcgtacagacaggaattccaggcttggactggagtgaagccctcaagatccacaaagacaaaaccagcccgagtcatcacaacccacacttcgggatgggacagcagccctggggccggcttccaggtcccagaggtgaggaagaagttcactcctaacccctccgccatctttcaggcctcagctccccggattctcaacgtgtgactgcctgcaccgtgacaccatggctgccgacaggacagggctggggagcggcctcaggacccactgccgcggggctgggcgagagcatggcatgggcccctgcgggagggcacagcccctctcaaagctgtcaccagggccaaagtgctggtgtggagcagatgcaccgatggacttggcacacccagctcagcctcaagcatcctcttgagaagcctgtggaaggctcctgcgttcgttaactgccatctggccgtctctcagttttgaaatctctgaggagcctgaggatcaagtcagttgggaaccgaattggtccatggaagctgaggaatgtggacacatccggcccttgaaagaaccagttatgtccacttttggtggatttcccaggatgcgtgagcacttgattaatttcataacctacagtgagacccttggctcttcctacaaatggcccctgcagttgaagctgttggaatcttgggccgtcacctgcatgactcatggtgatgctgagtatccaggaggaaatttccagaagaaacagaccgtcagtcacgggcttccacttcacagacctccttatggccaagatgagcctcatgttttaacaaaacagttcttgggattgaatgactcacatttaccttgtgctaggttctaaagattgaatccacattttgttactaatgattttcccgctaacataaggatgatgagcagggcactatcatacacactggctgagaactggaactgtttttgggaaggtggcatttgtctcattccctgaaataccttaaaatgtcctctacaccaacccttccgtctaccctgctcacatgtacagtgacggggaactcaccaccttttgaagaggcagttcattttctttgcaaagctctctcctaacttcctccgtaaattccagccagcatggccacatgggtcacgcctggtgccttcacacgtttgaggggtcttcgtctctttttaaagcttagaggtacaagctcaggacagtcttcagtaaggaaatttgtggatttccctttggatctttcttcctctccagcccacaagtggctctagtgagacgagcatttaagctgcaggtggtggcactcgggtctcagagccaccagacgtgcaggtgggacagtggttccagctccgactgcctgtcagcgtccctcccaggtgctagccctggcaggcacagccctcccctcatgccagcaaaggaaatgctcttgatgagaggctcgctttaaagaagcccaaagcgtgtgcttatccaaggggttcagctattcctgacttcacggcttgcatgtttgatttttctaagagaaaagaggctgcctgctgggtgtctgtggaaatgagattaaaaactgtacaatctcagattttactaaaatgcaaaaatgtagtttcagtttcttaaattataagcacgagtcttctcacgctt

SEQ ID NO: 891 - DNA, 5916 bp, Homo sapiens
ggctctgtgtatgaatgacaaggataccttcagccagctcattctggatgaatgaatgattacactaagtgtcctccacattcctctgtgggctcacttcatggactcactttgcgtgcttgttaaatgtgctgtgttgctcccaagaccatgtaaagcctactgaccactaacctccctcacagcagaaactagacgtcaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcaggttacaagtccaggtccctggcccgaagctgcctttctcactttaagagtaaccagccttacgcatcgagactcggtggccccacatgcaaggtctccagaggtgttgcctactccacgcacaggacaaatgccccagggaaggatttccagggcatcagtgctgctttctcaactgagaatggcttccactctgttggccacgagctggcagataaccacatcacctccagagactgcaacggacaccttctcaactgctacgggaggaatgagagcattgcctccaccccaccgggcgaagaccgcaagagcccccgagtgctcatcaaaacgctggggaagctggatgggtgtttaagggtcgagttccacaatggtggcaaccccagcaaagtgcctgcagaggactgcagtgagccggtgcagctgctgaggtactcacctaccttagcatcggaaacctcccctgtgcctgaagccaggagggggtccagcgccgattccctgcccagccatcgcccctctcccacggactctcgcctgcggtccagcaaaggcagctccctgagttctgagtcatcctggtacgactccccttggggcaatgctggagagctgagcgaggctgagggctccttcctggcccccggcatgcctgaccccagtctccatgccagcttcccacctggcgatgccaaaaagcctttcaaccaaagctcttccctctcctccctccgggaactgtacaaagatgccaacctggggagcctctccccctcaggtatccgcctttctgatgaatacatgggcacgcatgccagcctgagcaaccgtgtctcttttgcttccgacattgatgtgccctccagagtggcacacggggaccccatccagtacagttccttcactctcccctgtcggaagcccaaagcctttgttgaggatactgcgaagaaggactccctcaaagccaggatgcgacggatcagtgactggacgggaagcctctcaaggaagaaaaggaaactccaggagccgaggtccaaggagggcagtgactactttgacagtcgctctgatggactgaatacagatgtgcagggatcctcccaggcatctgcttttctgtggtcagggggctctactcagatcctgtctcagagaagtgaatccacacatgcgattggcagcgatcccctccggcagaacatttatgagaatttcatgcgagagttggaaatgagcaggaccaacactgagaacatagaaacatctacagaaaccgccgagtccagcagcgagtcactcagctctctggaacagctggatctgctctttgagaaggaacagggggtggtccggaaggccgggtggctcttcttcaagcccctggtcactgtgcagaaggaaaggaagcttgagctggtggcacgaaggaaatggaaacagtactgggtaacgctgaaaggatgcacgctgctgttttatgagacctatgggaagaattccatggatcagagcagtgcccctcggtgtgctctgtttgcagaagacagcatagtgcagtctgttccagagcatcccaagaaagaaaatgtgttctgcctcagcaactcctttggagatgtctaccttttccaggccaccagccagacagatctagaaaactgggtcactgctgtacactctgcttgtgcatccctttttgcaaagaagcatgggaaagaggacacgctgcggctgctgaagaaccagaccaaaaacctgcttcagaagatagacatggacagcaagatgaagaagatggcagagctgcagctgtccgtggtgagcgacccaaagaacaggaaagccatagagaaccagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgccgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaaaaaaaaaaaaactgttcattcctgggttttgtgcagtatacattttcccacaaaatggttgtaaagatttaagttattttaatttattgtggatcagaaacctagatgaaactggtcagaatctgtaaattacttagtttatatccactttgagcaggtatcaaatgatttaggatccttaaaattacattctaataattaagttatgtggaaaaagtaaggctggggaagtcgtgattaatagttttcaaagggccattttttaaaatcctctgggcattttctttcagctgtttgttagtttttgctttatttaaagcatatttaagttattttaatgtggtttaggggcaaaatgtgcagatacttcatttttgtaagatagattgtaatagatgctgtttatactaaacatgtcataactatctatacagtatatattaaaagaaagcttgtactgtatcttatttgatgatatttattttctctgccaagctgtatagtaaaaggaaaataagtcaca

SEQ ID NO: 892 - DNA, 3741 bp, Homo sapiens
aggcctaagcgcggccgccgtggctcctgcgtctcccatcgtgccgtgcgtcccgcgccgcgttcgagttctcggaggggagggggcgttagccccgcgcagccgccggcgtcgccgccatggacctaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacgtctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgacagccagacttggtgttgaggctgctggaaacagtgatagacgtcagcacagctgacagagccatccctgagtctcagatccggcaggtgatccacctgatcctggaatgttacgcagacctctccctgccaggtaaaaataaagtccttgcaggtatcctgcgttcctgggggcgaaagggcctctctgaaaagttgctggcttatgtggagggttttcaggaagacctcaatacaacttttaaccagctcactcagagtgcctccgaacagggcttggcaaaagctgtggcctccgtggcccgcctggtcatagtgcacccggaagtcacggtgaagaaaatgtgcagcctggctgtggtcaatctcggcacccacaagttcctggcccagattctcactgccttccctgcccttaggtttgtggaagagcagggtcccaattcatctgccactttcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgcttcagcaaatactggcagcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtgattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagccttggaaaccctcacctgctatgagactttgagcaagaccaacccttctgtcagctccttgctccagagggcacacgagcagcgcttcttaaagtccattgctgagggcatcggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacagttatgtgaaactgtccacaaaaagtcatggcaataatggtgtaaagaaaatagtttcttgggtatttgtaacgtacaaactatcataaaaattctcctctttcgcatctcactttgtctcttctaagtcggcctcagcaatagcccaggattaaatatgctctgaaattgggtttagtgtcttcaagatcaaatccagccaggaggaacatgttcataactggacttttccatcctagattttggcaaataagcccaaagttgaaaccatgtgagtggaaaaagcattacatggtacgtataaccccc

SEQ ID NO: 893 - DNA, 768 bp, Homo sapiens
cctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggtatgggctgggggacgggggggtggggggagtgttggaagaggactctagccagggtcatatctgccacaaagcacttgggccccctgcattcaggtgaccacccctcgcctccccttctccaggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctc

SEQ ID NO: 894 - DNA, 1050 bp, Homo sapiens
gacgtcacgtccggcgcggagacggtggagtctccgcactgtcggcggggagctttctcttgcataccctcgcttaggctggccggggtgtcacttctgcctccctgccctccagaccatggacggctccttcgtccagcacagtgtgagggttctgcaggagctcaacaagcagcgggagaagggccagtactgcgacgccactctggacgtggggggcctggtgtttaaggcacactggagtgtccttgcctgctgcagtcactttttccagagcctctacggggatggctcagggggcagtgtcgtcctccctgctggcttcgctgagatctttggcctcttgttggactttttctacactggtcacctcgctctcacctcagggaaccgggatcaggtgctcctggcagccagggagttgcgagtgccagaggccgtagagctgtgccagagcttcaagcccaaaacttcagtgggacaggcagcaggtggccagagtgggctggggccccctgcctcccagaatgtgaacagccacgtcaaggagccggcaggcttggaagaagaggaagtttcgaggactctgggtctagtccccagggatcaggagcccagaggcagtcatagtcctcagaggccccagctccattccccagctcagagtgagggcccctcctccctctgtgggaaactgaagcaggccttgaagccttgtccccttgaggacaagaaacccgaggactgcaaagtgcccccaaggcccttagaggctgaaggtgcccagctgcagggcggcagtaatgagtgggaagtggtggttcaagtggaggatgatggggatggcgattacatgtctgagcctgaggctgtgctgaccaggaggaagtcaaatgtaatccgaaagccctgtgcagctgagccagccctgagcgcgggctccctagcagctgagcctgctgagaacagaaaaggtacagcggtgccggtcgaatgccccacatgtcataaaaagttcctcagcaaatattatctaaaagtccacaacag

SEQ ID NO: 895 - DNA, 1021 bp, Homo sapiens
ggcacccccgtccgttccgactctcgcgagatccctactggctataaaggcagcgccccggagagctcttgcgcgtcttgttcttgcctggtgtcggtggttagtttctgcgacttgtgttgggactgctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtattcttcggcagatcactgtaaatgacctccctgttggccgctctgtggatgagactttgagactagttcaggccttccagttcactgacaaacatggggaagtgtgcccagctggctggaaacctggcagtgataccatcaagcctgatgtccaaaagagcaaagaatatttctccaagcagaagtgagcgctgggctgttttagtgccaggctgcggtgggcagccatgagaacaaaacctcttctgtattttttttttccattagtaaaacacaagacttcagattcagccgaattgtggtgtcttacaaggcaggcctttcctacagggggtggagagaccagcctttcttcctttggtaggaatggcctgagttggcgttgtgggcaggctactggtttgtatgatgtattagtagagcaacccattaatcttttgtagtttgtattaaacttgaactgagacctt

SEQ ID NO: 896 - DNA, 1143 bp, Homo sapiens
atagagaactcccgtaattggtcggagctctggaggcggggcttcgagcgtggctcgtgggttttccgtgaagtcgcggtgcagcggtgggcggcatgtctgtggccggtggggagattcgtggggacacggggggagaggacactgctgctcccggccggttcagcttcagcccggagcccacgctcgaggacatccgccgcctccatgctgagtttgctgcggaacgagactgggaacagttccatcagcctcggaatctcctcctggccttggttggggaagtgggggagctggcagaactctttcagtggaaaaccgatggggaacctggcccccaaggctggtcccccagggaacgggcagcccttcaagaggagcttagtgacgtcctcatctacctggtggcattagcagcccgctgccgtgtggatctgccgctagcagtgctctccaaaatggacatcaaccggcgacgctacccagcccatctggcccgcagctcttcccgcaagtatacagaattgccccatggggccatctctgaagaccaggctgtggggcctgcggacattccctgtgactccacaggccagacctcaacctagaaagatggccacaggacttgcaactcagggtggtgtctgaagagcagagagtggcctggccctggagcctttttctagtcttttcagaatagatcatgggcctgaggcctccacttcttgaggtctgaggcccagcagcctctagaaggtagcctcctggtgtttgttctcccagtaaaatggttttgggcgataacttctagattattcctggatggccagggaggctctctgtctcagcaggtgatgacgggggtaccaggggtgcctctgagacccattctcgtgtttccctgttgtaccttttgcctgcagggcagagagatctggtttctagcaaattcccagtaggatgtcatgtaagttccttccccctcttagagattgaaggctgtaagagtccagatggtggagccaggctgtctgggttcaaatgccatctttgacacttgcaagctaaatgacattactcaaattaatcgttctgcacttcagcttccttgtctatcaaataaaaagaatagtacctgcccaa

SEQ ID NO: 897 - DNA, 1023 bp, Homo sapiens
acacaaaggggtggtcaccctgccctcaccttgacctgtaagttgcctaggacagtggcctggtcccaggggctgttgtggggagttgaagaacaccctggcctcctccatcatgtcggccaagagggcagaattgaagaaaacacatctgagcaagaactacaaggcagtttgcctggaattgaagccagagccgaccaaaacatttgattacaaagcagttaaacaagaagggcggtttaccaaagcaggagtgacacaggacctaaagaatgaactcagggaagtgagagaagagctcaaggagaaaatggaggagataaaacagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgagaaatgtttgttgtgtgctctaaagaacaactacaatcgggggaacattccttcagaggcctcaggcctttacaaaggtggagaggagccagtgaccacccaaccttctgtgggccacgctgtgcctgccccaaagtcccagactgagggaaggtgaagcttaactgccagcttgaaatgagagtaaagaagatacagagcaaacagtgtttcagaaactgtcctgccctgggtgtgattctttggcttcaatttgaaggacgaggaatgatgggatttcatattttatttcacaccagttcctccttgtttcatctctttgctaagctggctgcttctaccatctaataaataattggccaagtt

SEQ ID NO: 898 - DNA, 2824 bp, Homo sapiens
cgttcacacctcctttccgagtatctgcatgccttgctggcccagagcacaagacccccattgtgctcccccggctcagaatccaaggaaagaaaggaagcgaagcctctgcattgagttctaggacagctgagacacttggattggacttaatcttaaacctctggagttcaagaccttttaaaaagggctaaataaacaatctctacatgtaaaaggccactgactcctacttcctctgtatagagcaactgttgaactcagctgcctgtagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccggcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaa

SEQ ID NO: 899 - DNA, 3036 bp, Homo sapiens
ccccgctcccaagtgcgcgcggacccctagctccctctgagttgcgctgggcttggctgctgcaccatgaccctggaggcgatccgctactcgcggggctccctgcagatcctagaccagctgctgctgcccaagcagagccgctacgaggcggtgggctcggtgcaccaggcctgggaggccatccgcgccatgaaggtgcggggcgccccggccatagccctggtgggctgtctcagcctcgccgtggagctgcaggcgggcgccgggggaccgggactcgccgcgctcgtggccttcgtgcgcgacaagctgagcttcctcgtcaccgcccggcccaccgctgtcaacatggcccgcgccgcccgcgacctggctgatgttgcagcccgggaggccgaacgggagggcgctacggaagaggcggtccgggagagacgtgaaacggagctatgcgagcattgggaagagcataccaggcagagggaactgccactgcgagggcccctgggcgggactgtgctcgagacccggccctacaaccagggagcccggctgacggcctttgagctggtctatgagcagatccccgccacccttatcaccgacagcatggtggctgctgccatggcccataggggcgtgtcagctgtggtcgtgggagctgaccgcgtggttgccaacggcgacacagccaacaaggtgggcacctaccagctggccattgtcgccaagcaccatggcattcccttctacgtggctgcccccagctcttcatgtgacctccgtctggagaccggcaaggagatcattattgaagagcgaccgggccaggagctgaccgatgttaatggggtccggattgcagcacctgggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaaccaactcagctctccctagcctgcctctctaggtttttcaatacatttcttgaatggctacccaaaagctgaccgtccagcccctgaccacacttgttcctagtgcagggagctcagacagggccttccatctagagcccagcacctagagccaggctgcccagattcaaatcctgactccgccacttttcccactgtatgatcttgggcaagtcacttcacctctctgtgccttggtttcctcatttataaaatgtggataacaggccgggcgcagtggctcacacctgtaatcccagcactttgggaggccgaggcaggtggatcacaagatcaggagattgagaccatcctggctaacatggtgaaaccccatctctactaaaaatacaaaaaattagccgggtgtggtggtgggcacctgcagtcccagctacttgggaggctgaggcaggagaatggcgtgaaactgggaggcagagcttgcagtgagccgagatagcgccactgcactccagcctgggcaacagagcgagactccgtctcaaaaataaatataattaattaattatttaattaaaaaaataaaaaataaatgtggataatactagtacctccctcttaaggtcagggctggagctagggtgacatctccagggcagaattttaagaggacaccaaaaaagctcagcaaccaagataaaaaatattttaaagcaatattttgttttgggttttttttttttgagatcaagtatcactcgttacccaggctggaatgtagaggcgagatctcagctcactgaaacctgtgcctccccggttcaagcgattctcctgccacagcctcctgagtagctgggattacaggcatgcgccaccatgcccagctaatttttctatttttagtagagacatgatttcaccatgttggccaggctggtctcgaactcctgactcaaatgatccccctgcctcagcctcccaaagtgctgggactacaggcatgagccactgtgcctgaccttacagcagtattttttaaaaatcaaaattaatgcaaaaatccatgatgaggccaggcttggtggctcatgcctgtaattccagcactttgggaggatcccttgagcccaggtgtttgagaccagtttgggtaacataggaagagcttgtctctacaaacaaaaatttaaaaacaatgagctgggcatggaactcacacctctagccccagctactcaggctgaagtgggaggatggcttgagcccaggagttcaaggatgcagtgtgctttgattgcactactgcacttcaccctaagcaacagagtgagaccccatctctttaaaaaaaaaaaaaaatccatgatgaacaaaacaagtatttgtttgagacggggtctcgctctgtcgcccaggctggagtacagtggtgccatctcagctcactgcaacctccgccttctgggttcaagcgactctcctgcctcagcctcccgagtagctgggattacaggagcctggcactatgcctggctaatttttgtatttttattggagacaccatgttagtcgtggctggtctccaactcctgacctcgggtgatccgcgccccgcggcctccgaaagtgctgggattacaagcgtgagccaccgtgcccggcctaaataaaattttgaagaggctagaaccccgcacttgtgccttgagcttactgacctcaacaccctggttccactaaaactttatttacaaaattatgctgccggtctgcaggatgtagtttaacaatttgattattttggatattaaaatattttttaagtcttgaaaatattgtttactattaccaaagtttttgaaccttcttaaattctgtaccagaggtgagtgccacaccctaacctagtctgagtttttatgtgtaaagatcataaaacgttgtaagttttctaaaacacataagctctcaataaacgttagcttatcattgtca

SEQ ID NO: 900 - DNA, 6434 bp, Homo sapiens
gccgcagccgcagccgcagcgacggcagccacgggagccgccgcgcattatgcaaagcggcggcagatgcgagcggggccagccgggcgcgcgtcggcctcccctcccagcggctccccccgccgccgcctgactctcccgggagactccctaggcccggacctggggccgaggagggccgggatggcctgagtgcccgcggcgcggcggcgcagcagcgggattgcaccatggggaaccaggatgggaagctgaagaggagcgcaggtgatgctttgcacgaaggcggcggtggcgccgaggatgcgctggggcccagggatgtggaagccacaaagaaggggagcgggggcaagaaggcgctaggcaagcacggcaaggggggagggggcggcggcggcggcggggagtcgggcaagaagaagagcaagtccgactccagagcctcggtgttttccaacctgcggatcaggaagaatctgtccaaggggaaaggcgccggcggctcccgcgaagatgtactggattcccaggccctgcagaccggggagctggacagcgctcactccctgctcaccaagactccagacctcagcctctcggcggacgaggccggcctgtcggataccgagtgtgcggacccttttgaggtgaccggtccagggggtcctgggcctgccgaggctagggtcgggggccggccgatcgccgaggatgtggaaactgcagcaggggcgcaggatggacaaaggaccagctcgggctcggacacggacatctatagcttccattcggctacggagcaagaggatttgctttcagacatccagcaggcgatccgcctgcagcagcagcagcagcagcagctccagctccagctccagcaacagcagcagcagcagcagctccagggcgccgaggagcctgcagcgccccccactgccgtctcccctcagcccggggccttcctgggcctggaccggttcctgctggggccgagcggcggggctggggaggccccgggcagtccggacaccgagcaggcgctgtccgcgctctccgacctgcccgagagcctggccgccgagccccgggagccccagcaaccgccgtcccccggcggcctcccggtctccgaggcgcccagtctcccggcagcgcaacccgcggccaaagactcgccctcctccacggctttcccatttcccgaggccgggccgggggaggaagcggccggagcccccgtgcgaggggctggggacacggatgaggagggtgaggaggatgcttttgaggatgcgccccggggctctccgggggaggagtgggccccggaggtgggagaggacgccccgcagaggctgggggaagagccggaggaggaggcgcaaggacctgacgcccccgcggccgcttccctgcccggcagccccgcgcctagccagcgctgtttcaagccctacccgctcatcaccccctgctacatcaagaccaccacccggcagctcagctcgcccaatcactccccgtctcagtcccctaatcagagccccaggatcaagaggcggccggaaccctccctgagccgagggtccagaactgccctggcctccgtagccgccccggccaagaagcaccgggccgacggcggccttgcggccggcctgagccgctcggctgactggacggaggagctaggcgcccgcacgccccgggtgggaggctccgcgcacctgctggagcgcggggtggcgagtgacagcggcggtggggtgtccccagcactggccgccaaggcgtctggggcccccgcggctgcggatggcttccagaacgtgttcacagggcgaacgctgttggagaagctgttcagccagcaggagaacgggcctccagaagaagcagagaagttttgctcccggatcattgccatgggtcttctccttccttttagtgattgcttcagggaaccgtgtaatcagaatgcccagacgaatgcagcttcgtttgatcaagatcaactttatacctgggctgcagttagtcaacccacacactcattggactattcagaagggcagtttcctaggcgagttccatccatggggccaccatccaaacctcccgatgaggaacacaggctcgaggatgctgaaacagaatctcaatctgctgtttcagaaactccccaaaaacgctcagatgctgtccagaaggaagttgttgacatgaagtctgagggacaggccactgtaattcagcagctggaacagactattgaggatctgagaaccaaaatagctgaactagagaggcagtatcctgccctggacacagaggtggccagtggtcatcaagggcttgagaatggagtgacagcctcaggcgatgtctgtctcgaagctctcaggttagaagaaaaggaagtacggcatcataggattttagaggcgaaatcgatacagacttcccccacggaagagggcggggtgctgacactgcctcctgtggatgggctgccagggcgtcctccatgcccccctggggctgaaagtggacctcagacaaagttctgttcagagatttctttgattgtgtctccaaggcgaatatcagtccagctcgacagccatcagcccacacagagcatctcacagcctccaccacctccatcccttctgtggtctgctgggcaaggacagcctgggtcacagccgccccattctatttctaccgagtttcaaaccagccacgaacactctgtttcctctgcctttaaaaacagctgtaacatcccatctccaccacctctgccttgcacagagtcctccagctccatgcctggcctgggcatggtgcctcccccacctccccctctccctggcatgacagtgcctactctgcccagtacagccattccccaacctcctcctctgcagggtacagaaatgctgccaccccctccccctcctcttcccggagcgggcatacctcctccgccgcctctacccggagcaggcatactccctctgccccctctacccggagcgggaatacctcctccgccccctctacccggagcggcaataccccctccgccccctcttcccggggcaggcataccccttcctccccctcttcccggagcaggaatacctcctccaccccctctacccggagcgggcataccccctcctcccccacttcccggagcgggcataccccctccgcccccacttcccggagcgggcataccccctcctccccctcttcccggagcgggcatacctcctccaccccctctacccggagcgggcataccccctccgcccccacttcccggagcgggcataccccctccgcccccacttcccggagcgggcataccccctcctccccctcttcccggagcgggcatacctcctccaccccctctacccggagcgggcataccccctccgcccccacttcccggagcgggcatacccccacctccccctctacccggagcgggcataccccctccgccccctctacccggagtgggcatacctcctccgccccctctacccggagcgggcataccccctcctccccctctacccggagcgggcataccccctcctccccctcttcccggagcgggcatacctcctccaccccctctacccagagtgggcataccccctccgcccccacttcccggagcgggcatacccccacctccccctctacccggagcgggcataccccctccgccccctctacctggagtgggaatacctcctccgccccctctacctggagtgggaatacctcctccgccccctctacctggtgctgggattcccccacctcctcccttgccaggtatggggattccacctgctccagctcccccactccctccacctgggacaggaatcccaccgccccctctgcttcctgtatcaggccctccactcctcccacaagttgggagtagcactttaccaaccccacaggtgtgtggatttcttcctcctccattgccaagtggcttgtttggattagggatgaatcaggacaaagggagtaggaagcagcccatagagccttgtcgaccaatgaagcctctttactggaccaggattcaactacatagtaaaagagactccagtacttcacttatttgggaaaaaattgaagagccatccatagattgtcatgaatttgaggaattattttctaaaactgctgtaaaggagagaaagaaacctatctctgatactatctcaaagacgaaggctaaacaagttgtcaagttattaagcaacaaaagatcacaagcagttggaatactaatgtctagccttcatttagatatgaaagacatacaacatgctgttgtgaacttggataattctgtggttgacctggagacccttcaagctctctatgagaatagagcacagtcagacgaactcgaaaaaatagaaaagcatggccgatcttccaaagacaaggaaaatgccaagtctctggacaaacctgaacagttcctttatgaactgtcactaatccccaacttttcagagcgagtcttttgcatcctgttccagtccacattttcagaaagcatttgctcaattcgtcgcaaactggaattactacagaaattgtgtgagacattaaaaaatggcccaggggttatgcaggttctaggtttggttcttgcctttggcaactacatgaatggaggaaataagactcgaggacaggcagatggctttggattagacattcttccaaaactgaaagatgtcaagagcagtgacaatagcagaagccttttgtcatatattgtttcgtattatctccgaaattttgatgaggatgctggaaaagaacagtgcctctttccactgccagaaccccaggacctttttcaggcctcacagatgaagtttgaagattttcaaaaagatctcagaaaactgaagaaagacttgaaagcctgtgaagttgaagcagggaaagtataccaggtctcctcaaaagagcatatgcagcctttcaaggaaaacatggaacaatttattattcaagccaaaattgaccaagaggcagaggaaaattcactgacagagactcataaatgctttttggagaccacggcatatttcttcatgaaaccaaaacttggagagaaggaggtgtccccaaatgctttcttcagtatctggcatgaattcagctctgactttaaagacttctggaagaaagagaacaaacttcttctacaagagagagtaaaagaagccgaagaggtgtgtagacagaagaaaggaaaatcactttataaaataaaaccaagacatgactctggaattaaagcaaagataagcatgaaaacttgaacaatgaaaagcagaatgaaaatgagtcattgcaacgactttcacaaaattcagctgacctgagagtgggagggaaactaccgtcattctgctcatgtttcttcttgacctcttgcataatctttttgttttctagacagttcactaattgttgaattttactgtatattcatataaaaatgcaaacgtactagaccagtggagaatttgacaccttttctttttgtaaaagtttatggtattataccgatagaccaaaacagcatgtgtaagaggcagtatctgcactaattctcaacatgctaaacattaactacaattcactgttgtgagaatattcctcgtcacagcaaaaacactttcctttctactgacaaccagtcctccacatcacagcatttagacatatgggtaaaatgttatttctagtgaattgtttgtatcagtttcatgtctaagtataaattttctattttaaaatttaagaaccgtttataatcagtgctttcccaactcttgggttgctctccataactatgtatttgtgaaagaaaatggtcattttttttactgaagtcatataatgacttgggtcagctcgtaatgcattgtgatggttttgtatgagctgggtgtttttttccattacttttaatgatcttcgttgcaagttatagttgtggataaaggggagaatttattgctcttgcaaaccaattatggaaagcaacttaagaaaaccaatgttctaaatcataattgtttgtatttatgtaaagtatggtctcttactttttagtttgtagtttaagtgcaaagaaacagtagtggttttttttctattgttttgtagtcttcctgtccccttcagtccctccagtgtgtatattaccattctccaatgaaataatagggcatttaacaaagatcgctatgtgcaatactgtatttagtgtttctatttcaatttttctaggatgttaatttatatgaaaataaaatgaataataaaagaataaagatacttgcaaaaga

SEQ ID NO: 901 - DNA, 5219 bp, Homo sapiens
ctcgcgcggcttcccgcttccggctcccagctgctagctactgtggatctgggggggccggacggaggcatcggaggcggctgcgagagtggcagaggagctggcggagagcggcctgcgggcgatcgggccgagcctcgctcaaggagcacccccggggcaccctcctgtccgatggcagcccggccctgtccaggaatgtcggtatgacggtctctcagaaagggggtccccagccaacaccgagcccggctggccctgggacgcaactcggaccaatcacaggagagatggatgaagccgattctgcgtttttaaaatttaagcagacagctgatgactctctgtcccttacatctccaaacaccgagtccatttttgtagaagatccctacaccgcctcgctgaggagtgagattgagtcagacggccacgagtttgaagctgagtcctggagcctcgccgtggatgcagcctacgccaagaagcaaaagagggaggtggtgaaaagacaagatgtcctttatgagctgatgcagacagaggtgcaccacgtgcggacgctcaagatcatgctgaaggtgtactccagggccctgcaggaggagctgcagttcagcagcaaggccattggccgcctcttcccatgcgctgacgacctgctggagacgcacagccacttcctcgctcggctcaaggagcgccgccaggagtccctggaggagggcagtgaccggaattatgtcatccagaaaatcggcgacctcctggttcagcagttttcaggtgaaaatggggagagaatgaaagaaaagtacggtgtgttttgtagtggccacaatgaagctgttagtcattacaagttgctgcttcagcaaaacaagaaatttcaaaacttgatcaagaaaattggcaacttctccatcgtgcggcggcttggcgtgcaggagtgcattctcctggttacacaacgcataaccaaatacccagtgctggtggagcgcatcatccagaacacggaagctggcactgaggactatgaagacctgacccaggccttgaacctcatcaaagatatcatctcacaagtggacgccaaggtcagtgagtgtgagaagggccagcgcctcagggagatcgcagggaagatggacctgaagtcttccagcaaactcaagaacgggctcaccttccgcaaggaagacatgcttcagcggcagctccacctggagggcatgctatgctggaagaccacatcagggcgcttgaaagatatcctggctatcctgctgaccgacgtacttttgctgctacaagaaaaagatcagaaatacgtctttgcttctgtggactcaaagccacccgtcatctcgttacaaaagctcatcgtgagggaagtggccaacgaggagaaagcgatgtttctgatcagcgcctccttgcaagggccggagatgtatgaaatctacacgagctccaaagaggacaggaacgcctggatggcccacatccaaagggctgtggagagctgccctgacgaggaggaggggcccttcagcctgcccgaagaggaaaggaaggtggtcgaggcccgcgccacgagactccgggactttcaagagcggttgagcatgaaagaccagctgatcgcacagagcctcctagagaaacagcagatctacctggagatggccgagatgggcggcctcgaagacctgccccagccccgaggcctattccgtggaggggacccatccgagaccctgcagggggagctaattctcaagtcggccatgagcgagatcgagggcatccagagcctgatctgcaggcagctgggcagcgccaacggccaggcggaagacggaggcagctccacaggcccgcccaggagggctgagaccttcgcgggctacgactgcacaaacagccccaccaagaatggcagtttcaagaagaaagtcagcagcactgaccccaggccccgagactggcgaggccccccaaacagcccggacttgaagctcagtgacagtgacattcctgggagctctgaggaatcgccgcaggtggtggaggcgccaggcacggaatccgatccccgtctgcccaccgtcctggagtcggagcttgtccagcggatccagacactgtcccagctgctcctgaaccttcaggcggtaatcgcccaccaggacagctatgtggagacgcagcgggctgccatccaggagcgggagaagcagttccggctgcagtcgacgcgtgggaacctgctgctggagcaggagcggcaacgcaacttcgagaagcagcgggaggagcgcgcggccctggagaagctgcagagccagctgcggcacgagcagcagcgctgggagcgcgagcgccagtggcagcaccaggagctggagcgtgcgggcgcgcggctgcaggagcgcgagggcgaggcgcggcagctacgcgagcggctggagcaggagcgggccgagctggagcgccagcgccaggcctaccagcacgacctggagcggctgcgcgaggcccagcgtgccgtggagcgcgagcgggagcgcctggagctgctgcgccgcctcaagaagcagaacaccgcgccaggcgcgctgccgcccgacacactggccgaggcccagcccccaagccaccctcccagcttcaacggggaagggctggagggccctcgtgtgagcatgctgccatccggcgtggggccagagtacgcagagcgccccgaggtggctcgccgggacagcgcccccaccgagaaccggctggccaagagcgatgtgcccatccagctgctcagcgccaccaaccagttccagaggcaggcggccgtgcagcagcagatccccaccaagctggcggcctccaccaagggtggcaaggacaagggcggcaagagcaggggctctcagcgctgggagagctcagcgtccttcgacctgaagcagcagctgctgctcaacaagctcatggggaaagatgagagcacctcacggaaccgccgctcgctgagccctatcctgcccggcagacacagtcctgcgcccccaccagaccctggcttccccgccccgagcccaccgccagctgacagcccctccgagggcttctctctcaaggccgggggcacagccctcctgcccgggcccccagctccctcgccactgccggccacaccactcagcgccaaggaggacgccagcaaagaagacgtcatcttcttctaaaagggccgtgactcaaggaaagtttttaatggaaagttgagccagaactaaaccagggagctgtctgaaatcatagcaccccatccgggtggcggggagatcaactccgagctgtttttccgaggcagtgaggaacggtgccggctctgcacggagctgaggacaggacagaccttgctttgagaaggagctgccggccggggccacgctccacagccgccgcgcgacagtggagccaagggttagggcaccaggaggggccaggtggcgtcggcagcatctgtccccagaatcaggcagaatccacttcccaaacagagccccacgcaggttcaccatgaacctcagggtcagggaatgagccaggcacgggggcatgggcagagagggccacggggcagggcccactgagggaacatcagtggccctccagtcaggttctgtgggtttggaagcccatcgtgaaaggggctgacctttgcccctttttacttggcattggttttgaaaccagctgtttcccaaactctgcttcccaagggcaaccgttgctgttcacacgctcagcctgtctgggggagcgggcctctagcttcagccagggcgggtacacaccctgggcacagggtcctcagcccccgggaaatgagctcccagggctggcgtcccaccttccaggtgggggctggcacatcacagactgtcgagagcgccatgtcccagggcatgcagaggatgcacctagagacgttgcagcaagtggacaagtggccgctgtgcgggcccctcgcttgtagtgagctgttgcagcttacggtccgttccctggaggggtggaggaaggaggtgttgggcagcatcaaaggtgctgggacatcccagggtggtgagatccatccacgatccagctccggtggagaaagggcccatgtcaagccttgttctgcaccccaagcattggtggtaggactgggtcctggctgatcgtccttgttcccagtggggtacatgtgagcccctgccagggccaagtccttctcccgaacccagggtcctgggaactgcagatcccggggggattcagcccttctcccactgtgctggcagaggcactcctgtgacgctgaatacagtgaacagggacattcccgccactcggggacagatgggcacaagggaggggaaactccatcaggaagtgctcccctgggcagaggcgcccactgggtgctgtgggctcaggagggggcggggcaggagctggtgccaaccgggaaccagagccccacagccatacagcccattggtgacaaggtcctgagaacacagtggccaggtgtccccaggctcctggcccctccgacgacctcaactctgcccagcccggtccctggccatcagcgacgctgtccgccccccgtcagatcccatgtgtgccatgtttatcatcagtgttttgtatttttgtactgagtatcggagcactttacagaagctgactgtacattcctgttctgttgtgaagagaacattcccagaccctggcaccctcctgagccggcgtgtgccggtccagccctccgagatgccacaattccttggatgggggagaagttcaaggaatttctgctcggccacgcggtgggaaccccgcgtccccgccatgtggcagaggggtctcagtcgtgctaggcatcgggcggcagcgccgacagcccttccctcgccagtgcccctcggccactcctgggttggagcccgattttatttgtaaagttgacagtcgagcaaatgttcctattttcgtgggatctgcacacgtctttgtcagttgtggtcatgatcttagtcacctgctaattatttttacaatgattacaacatttcctcactgcgggatatttctgacccgctttagaacttaagacctgattctagcaataaacgtgtccgagatgagcggtg

SEQ ID NO: 902 - DNA, 3190 bp, Homo sapiens
agcgcttgtgacggtgtgaccagggaggggaagtgtaagtgtctggccgtccgtggtggcggggccagcaggctgtcccagccctcacccggagctcctcacccggcaccacatctgtgttttcccaggacccacgcagccacccagcctcagcactcatctgcgcagccatggaggccctgggacctgggggcgaccgcgcctccccggcctcgtccactagcagcctggacctgtggcatctgtccatgcgcgcggactcggcctacagctctttctccgcagcctccggcggccccgagccgcgcacgcagtcgccggggacagacctccttccttacctagactgggactacgtgcgtgtggtttggggcggcccgggccccgccccgcccgacgctgccctttgcacatccccgcggccccggcccgcggttgcagcccgcagtgggccgcagccaacagaggtcccggggaccccgggaccactgaacaggcaggccaccccgctgctgtacgcgctggcggccgaggcggaggccgcggcgcaggctgccgagccgcccagcccgccggcctcgagggccgcctaccgccagcggcttcagggcgcgcagcggcgagtgctccgggagacgtcgttccagcgcaaggagctccgcatgagcctgcccgcccgtctgcggcccactgtcccagcgcggcccccggcgactcacccgcgctccgcctcgctcagccacccgggcggggagggggagccggcgcgctcccgggctcccgcgccaggaactgccggccggggtcccctcgccaaccagcagcggaagtggtgcttctcagagccaggaaagctggatcgtgtgggtcggggcggtgggccggcgcgggaatgcctgggtgaggcctgctccagctctggcctccctgggcccgagcccttggagttccagcatccggcgctggctaagtttgaagatcacgaggtcggatggctgcccgagacgcaaccccaaggctccatgaacctggactccgggtccttgaagctcggtgatgccttcaggcccgccagtcggagtcggagcgcttcaggcgaagtcttgggttcctggggaggatcaggagggaccatacccattgtccaggctgttccccaaggagcagaaacccccagaccattgtttcagaccaaactttccaggttcttgcctcagaaagaggctgcggtgatgtatcctgcagagttaccccagagcagccctgctgacagtgaacagagggtctcagagacctgcattgtgcctgcctggctcccctcccttcctgatgaagtgttcctagaagaggccccactggtcagaatgagatcaccaccagacccccatgcctcccaggggcccccagccagtgtccatgcctctgaccagccgtatggaactggcttaggccaaagaactggccaggttacagtccccacagagtacccgctccatgagtgtccaggaactgcaggggcagatgactgctggcagggggtgaatggttctgtaggtatttccaggcccacaagccacacccccactgggactgcaaatgataacatcccaactattgaccccactggactgaccaccaatccccccacagctgcagagagtgacctcctcaaacctgtcccagctgatgccttgggactttcaggcaatgatactccaggtccctctcacaatactgccctagccaggggcactggccagcctggttccaggcccacatggcctagtcagtgcctcgaggagctggttcaggagctggccagattagatccctctctatgtgaccctcttgcttcccagcccagcccagagccacccctgggcctgctggatggactgattcctttagcagaggtccgggctgcaatgcggcctgcctgtggggaggctggagaggaggctgccagtacttttgagccagggtcctatcagttcagcttcacccagctcctgccggctcctcgggaggagacaaggcttgaaaaccctgccacccaccctgtgcttgaccagccatgtgggcaggggctccctgcaccaaacaacagcatccagggcaagaaagtggagctggccgcccgcctccaaaagatgcttcaggaccttcacacggagcaggagcggctgcagggggaggcacaagcgtgggccaggcgccaagcggctctggaggctgcagtgcgccaggcctgtgcccctcaggagctggagcggttcagccggttcatggccgacctagagcgcgtgcttggccttctgctgctgctgggcagtcgcctggcgcgcgtgcgccgcgccctggcccgggcggcctcagacagcgaccctgatgagcagcgactccggctcctgcagcggcaggaggaggacgccaaggagctgaaggagcacgtagcgcggcgcgagcgggccgtgcgggaggtgctggtgcgagcactaccggtggaggagctgcgcgtctattgcgccctgctggcgggcaaggccgccgtcctggcccagcagcgcaacctggacgagcgcatccgcctccttcaggaccaactggacgccatcagggacgaccttggccatcatgccccgtctcccagcccggcgcggcccccagggacctgtcctccagttcagccgcccttccctcttctccttacatagttataggtggagagggtggggtgcaccgcccctatctctcacccacgtaagtggggtgatgctgatttagtctctgcttttcccttgagggattggggaggacccagtccaggcctttctaagatactcctccagccgggcgcggtggctcacgcctgtaatcccagcactttgggaggccgaggcgggcggatcacaaggtcaggagatcgagaccatcctggctaacacggtgaaaccccgtctctactaaaaatataaaaaattagccgggcgtggtggcgggtgcctgtattgccagctactcggaaggctgaggcaggagaatggcgtgaacctgggaggtggagcttgcagtgagcggacatcgcgccactgcactccagcctgggcgacagagcaagactccgtctcaaaaaaaaaaaaaaaaaaaaaaaaaaaaaagatacttctccaaagtgttctcatgtggcctc

SEQ ID NO: 903 - DNA, 3018 bp, Homo sapiens
ggactgtgggagcggcttccttggattccgcgcttggcaacggctcggcgtcgcgctttggccaaccgctgcgtcgtccctgggcccgaataactgtcgcccgcttccctcagcgtgaggtgaagcacttcaaattgcctgatgaaagttgaatcaggaatgaagataaaagtacacaacaatgcagaaagcggtacttagcctcacaaagatggaaacattccaaaaacgtgaaaaactgcagtaggcttcttggaagtagaccaagggtgtccaatctttggcttccctgggccacatcggaagaagaattgtcttgggccacacatgaaattcacaaacactaaggtacaaatgatgcaaaatgtgcacctggctccagagacagatgaagatgatctttattccggctataatgactacaatccaatctatgatatcgaggaattggagaatgatgcagcttttcagcaagctgtgaggactagtcatggcagaagacctccaataactgctaaaatatcaagcacggcagttactagacctatagctactggatatgggtccaagacatctctggcatcatcaataggaagaccaatgacaggggctattcaggatggagttactagacccatgacagcagtgagagcagctggttttaccaaagcagctttgagaggctctgcatttgacccccttagtcagtcaaggggccctgcttcccctttggaagccaagaaaaaagatagcccagaggaaaaaataaagcaattagagaaggaagtaaatgagttggtagaagaaagctgtattgccaatagttgtggagacttaaaattggccttagaaaaggcaaaagatgcaggaagaaaagagagagtcctggtgagacagcgagaacaagttacaactccagaaaatatcaatttggatttaacttactcagttcttttcaatttggccagtcagtattcagttaatgaaatgtatgccgaagcacttaacacttatcaagttatagtcaaaaataagatgtttagcaatgcaggaatattgaaaatgaatatgggaaatatctatttaaagcaaagaaattattccaaagccattaaattctaccgaatggcattagaccaagttccaagtgtcaataagcaaatgaggattaaaataatgcagaatattggagttacatttattcaggctggtcagtattcagatgctattaattcatatgagcacataatgagcatggcaccaaatctgaaggcaggctacaacctaactatctgttattttgctattggagaccgagaaaaaatgaagaaggcattccaaaaattgattactgttccattagaaattgatgaagataaatatatttcaccaagtgatgatcctcatactaacttagtaactgaagctataaaaaatgatcacctcaggcaaatggaacgtgaaaggaaagccatggcagaaaaatatattatgacatctgcaaaactcattgctcctgtaattgaaacatcttttgctgcaggttatgattggtgcgtggaagtggtgaaagcttctcaatatgtagagctagccaatgatctggaaataaacaaagcagttacatacttgagacaaaaagactataaccaagctgtagagatcttaaaagtgttggaaaaaaaggacagtagagtgaaaagtgcagctgcaaccaatctctcagccctgtattatatgggaaaggattttgcacaagccagcagctatgcagatatagctgtgaactctgatagatataatccagcagctcttactaataaagggaatacagtttttgcaaatggtgattatgagaaggccgctgaattctataaagaggctctaagaaatgattcttcttgtactgaagcactttataatattggccttacctatgagaaactaaatcggctagatgaggctttggactgtttcctgaaacttcacgcaatcctacgaaacagtgccgaagttctttaccagatagcaaatatatatgaattaatggaaaatcccagtcaagctattgaatggctaatgcaggtggtcagtgttattccaaccgatcctcaagttttatctaagctaggagaattatatgatcgtgaaggagataaatctcaagcatttcaatattactatgagtcatataggtattttccttgtaatattgaagtcattgagtggcttggagcctattacattgacacccaattttgggaaaaagctattcagtactttgaaagagcttctcttatacagcctacacaagtgaaatggcagctgatggtagctagttgtttcagaagaagtggtaactaccaaaaagcattagatacttacaaagatactcacagaaaatttccagaaaatgtcgaatgtctgcgtttcttagttcgtctctgcacagatcttggattaaaagatgctcaagaatatgccagaaaactgaagaggttggaaaaaatgaaagaaataagggaacagcgcataaagtcaggcagagatggcagtgggggctcccgtggcaaaagagaaggaagtgctagcggtgatagtggccagaactatagtgccagtagtaaaggtgaacgactaagtgccagactcagagctttacctgggacaaatgaaccttatgaaagtagcagtaacaaagaaatagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaactaa

SEQ ID NO: 904 - DNA, 2207 bp, Homo sapiens
ccgcgccggaggacgagcctcggtcatcgcgctgccctcccaggttcaacaggctacccatgtgcccgctccagtaagcgtgcaaccagcccggtcagtcccagggactttaccggctaggagacaccttgaacgtccccagcgcgactcccacaaactgccttgactctttaacgcttcctcgctggcgcccattgggccaggcgtttacgtcatcgctgcgcgccgggcggcggcgacttcccgctccttgactctgacgtcagagcggcgccggcctcggcggctgaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaatcta

SEQ ID NO: 905 - DNA, 2818 bp, Homo sapiens
ggtgcgcggagggcgcgtctctgacggaagccggggcggacggtcggagtccggaagaaaaacagtccgcgacagctaggcgcgtgagaccggccgcccgcagggctgctctggccgggacccgctggccgggagacgcgaacctgccggaccaccgcgcggggacgacggcggccatgagctcgcggaagctgagcgggccgaaaggcaggaggctcagcatacatcaggaggtctgcctgatcccatggtgaaccccgggaatccgaaatcagattgagataagatcctttagggaagtgacttagcctggtctcttgcctgctctttcacggggaacaacgctaatcgcccacttagtctaagtcacgatgcttggatttgctgctaatcgtcggatttgagagtgggaacaagaaatccggacttttgctctccatcctcttagacatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcct

SEQ ID NO: 906 - DNA, 2389 bp, Homo sapiens
cacaagctctagagggcttccgggaggaggcttagggagctgggaatccgggagcagatggtgggttcctaccgtcgagggtgggagagagggatctgaggccaagtttgaggtaaggactgtggagctccatcagatccccatccccacctcccctcatctgcgcaatcctgcgagaagccttagacaggttctggctcagagaaccggagagaggcacaacgcctggcccccaggacttggccacagcgtccctgaccttgtctgctccatgacctctcactgaggcccattaacccctcagttccctgatgaggcttgatttagcatccttgatgtcagctcctaagagtctgggaagtgcatttaagtcctggaggttggacaaggccccctccccacagcacacctttccatccacttctatcccaggcatggcttttgctctcctggcctccgtgcccccggtgtttggactctacacttctttcttccccgtcctcatctacagcttgctaggtactgggagacacctgtccacaggaactttcgccatactcagcctcatgacaggctcggccgtcgagcggctggtgccggaacccctcgtggggaatctgagcggaatcgagaaggagcagctggacgctcaacgggttggggtagccgcggccgtggccttcgggagcggggcgttgatgctggggatgttcgtgctgcagctcggcgtcttgtccacctttttgtccgagcctgtggtcaaggcgctgaccagcggggccgcgctgcacgtgctcttgtcccagctgccgagcctcttggggttgtccctcccgcgccagatcggctgcttctctctcttcaagacgctggcctccttgctgactgcgctgcctcggagcagtccggccgaactgaccatctccgcgctcagcctggcgctgctcgtgccggtcaaggaattgaacgtgagattccgagaccggctacccacgccgatcccgggggaagtcgtcttggtgcttctggcctccgtgctctgcttcacctcttctgtggacacaagataccaagtccagatagtggggctgttgcctggaggatttccccaacccctcctccccaacctggctgagctgcccaggattctggctgactcgctgcccattgcactggttagttttgcggtgtctgcctccctggcctccatccatgcagacaagtatagctacactattgactccaaccaggagttcctggcacatggtgcctccaacctcatctcctccctcttctcttgctttcccaactcggctacgctggccaccaccaatctactggtggatgctggtgggaaaacacagctggcaggcctcttctcctgcacagtggtcctgtcggtgctgctgtggctggggcccttcttttactatctgcccaaggctgtcctggcttgcatcaacatctccagcatgcgccaggtgttctgccagatgcaggaacttccacaactatggcacatcagccgagtggactttctcctccaggtcccggggctctgcatcctgagctatccaacaccactgtactttgggacccgtgggcagtttcgctgcaacctggagtggcacctggggctcggagaaggagaaaaggagacttcaaagccagatggcccaatggttgcagttgctgagcctgtcagggtggtggtcctagacttcagtggtgtcacctttgcagatgctgctggggccagagaagtggtgcaggtgagggagaggctggccagccgatgtcgagatgctaggatccgcctcctcctggctcagtgtaatgccttggtgcaggggacactgacccgggtaggactcctggacagggtgactccagatcagctgtttgtgagtgtgcaggatgcagctgcttatgccctggggagcctgttaaggggcagtagcaccaggagcgggagccaggaggcactgggctgcggcaagtgaggcaggggtaagtggctggagacccagggagaggggtttgggaaagggtctgaggaagatcaagaagaaaagggtggggacggaatgaatagtagattgaagaccaaatcagggagcccgggctgagctatgggtgaggaactgaagaactcagatccctaagtaggtggggtacccctgagaggactgccacatttcattaaggaagaggggtgcctaatctattcctgacatgtctcctctcttctccaggagctcactgacccaaagatttgcaccgtgtgggtctgacctcatcatgtggagtgcagagggccctgatgacatgtgtgtgatgaggaccatgacccttgaacccccttacctaacgtaactaataaaatgaa

SEQ ID NO: 907 - DNA, 4392 bp, Homo sapiens
cctcggcctccgtaacccccgcctagccgggccatggcggaacgcggaggggcgggcggtggtcccggaggcgccgggggcggcagcggccagcggggatccggggtcgcccagtcccctcagcagccgccgccgcagcagcagcagcagcagccgccgcagcagccgacgccccccaagctggcccaggccacctcgtcgtcctcgtccacctcggcggcggctgcctcctcctcgtcctcgtctacctccacctccatggccgtggcggtggcctcgggctccgcgcctcccggtggcccggggccaggccgcacccccgccccggtgcagatgaacctgtacgccacctgggaggtggaccggagctcgtccagctgcgtgcctaggctattcagcttgaccctgaagaaactcgtcatgctaaaagaaatggacaaagatcttaactcagtggtcatcgctgtgaagctgcagggttcaaaaagaattcttcgctccaacgagatcgtccttccagctagtggactggtggaaacagagctccaattaaccttctcccttcagtaccctcatttccttaagcgagatgccaacaagctgcagatcatgctgcaaaggagaaaacgttacaagaatcggaccatcttgggctataagaccttggccgtgggactcatcaacatggcagaggtgatgcagcatcctaatgaaggcgcactggtgcttggcctacacagcaacgtgaaggatgtctctgtgcctgtggcagaaataaagatctactccctgtccagccaacccattgaccatgaaggaatcaaatccaagctttctgatcgttctcctgatattgacaattattctgaggaagaggaagagagtttctcatcagaacaggaaggcagtgatgatccattgcatgggcaggacttgttctacgaagacgaagatctccggaaagtgaagaagacccggaggaaactaacctcaacctctgccatcacaaggcaacctaacatcaaacagaagtttgtggccctcctgaagcggtttaaagtttcagatgaggtgggctttgggctggagcatgtgtcccgcgagcagatccgggaagtggaagaggacttggatgaattgtatgacagtctggagatgtacaaccccagcgacagtggccctgagatggaggagacagaaagcatcctcagcacgccaaagcccaagctcaagcctttctttgaggggatgtcgcagtccagctcccagacggagattggcagcctcaacagcaaaggcagcctcggaaaagacaccaccagccctatggaattggctgctctagaaaaaattaaatctacttggattaaaaaccaagatgacagcttgactgaaacagacactctggaaatcactgaccaggacatgtttggagatgccagcacgagtctggttgtgccggagaaagtcaaaactcccatgaagtccagtaaaacggatctccagggctctgcctcccccagcaaagtggagggggtgcacacaccccggcagaagaggagcacgcccctgaaggagcggcagctctccaagcccctaagtgagaggaccaacagttccgacagcgagcgctccccagatctgggccacagcacgcagattccaagaaaggtggtgtatgaccagctcaatcagatcctggtgtcagatgcagccctcccagaaaatgtcattctggtgaacaccactgactggcagggccagtatgtggctgagctgctccaggaccagcggaagcctgtggtgtgcacctgctccaccgtggaggtccaggccgtgctgtccgccctgctcacccggatccagcgctactgcaactgcaactcttccatgccgaggccagtgaaggtggctgctgtgggaggccagagctacctgagctccatcctcaggttctttgtcaagtccctggccaacaagacctccgactggcttggctacatgcgcttcctcatcatccccctcggttctcaccctgtggccaaatacttggggtcagtcgacagtaaatacagtagttccttcctggattctggttggagagatctgttcagtcgctcggagccaccagtgtcagagcaactggacgtggcagggcgggtgatgcagtacgtcaacggggcagccacgacacaccagcttcccgtggccgaagccatgctgacttgccggcataagttccctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagcagcgccctggccatcgtggggagccctaatagcccatatggggacgtgattggcctccaggtggactactggctgggccaccccggggagcggaggagggaaggcgacaagagggacgccagctcgaagaacaccctcaagagtgtcttccgctcagtgcaggtgtcccgcctgccccatagtggggaggcccagctttctggcaccatggccatgactgtggtcaccaaagaaaagaacaagaaagttcccaccatcttcctgagcaagaaaccccgagaaaaggaggtggattctaagagccaggtcattgaaggcatcagccgcctcatctgctcagccaagcagcagcagactatgctgagagtgtccatcgatggggtcgagtggagtgacatcaagttcttccagctggcagcccagtggcccacccatgtcaagcactttccagtgggactcttcagtggcagcaaggccacctgaggccctgtctcccagccactttccctcctggcactgccaccagcctcaccgcctgcgggcagggggaggccagcaggcccgggcccagcaccccttccctggcaccagggtctgcctctcactcgcccaggtcccgaaggacactgccacagggacgccttccctcccctcccctccagcccacccctgcacagcccctcctccttcccgcttttccccttctccctcctgctccaggcccaaggcgtgttggttttgccttctggtgcccatagtcccctggactgagtcccccaggccttccttcacccgacttccaaactcttccttgtggtatcagtttccttctcggaaatgagaaagctggaatcctggtccccagcaggagagcctagtcctcccccagcccctccagccaccagggtgtcctctaggatgcagctgccagatccactcactctgctgcctccagcaggacccaaggccactttcaactcttatggggttctccacctgccccagagcttctcaagggagggtaagggggcaccctgagcccacaggacccctacttcacagctcacaggggcaggaggcagctcccctgcctccaggaccctgttgctatggtgacacagcgtttctaggacagaggggcctcccagtctccccccaccacccgtgcacgacttcctcaccacccccaggttccctgcagatgtcgtgtgtgtcctgagtgtttctttggttctttgcacgccaagtctcttggttgtaccatgtgacacaccctgtgcactggtcgctgtcttcgtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctcccaccgtgtcagtttttctgcctttccctgctctgttcttccccctccttaggccccagcctgggcccagacccatcctcccagccaggtttccctccagcaggctccttccctccctgtcacctccctctcaccaacccggggtctgagcccctcattcctgaccgtccgtgttctcaggagtggttgaggacacagggccccagcccagccctctgcaccccccagcccggccatctgcgccccacagcccctttggagcttttctcttgtcctctcactccttcccagaagtttttgcacagaacttcattttgaaagtgtttttctcattctccatacctcccccaagctctcctccagcccttcccagggctcagccctgctgtcctgagcgtctcctgggccagagagaggagatgggggtgggagggactgagttgatgttgggtttttcattcaataaattggtgatttcttaccgactgc

SEQ ID NO: 908 - DNA, 1601 bp, Homo sapiens
aacggctagagacgcccagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggagtttgtgacattcgaggatgtggctgtgcaccttactcgagaggaatggggatacctggaccctgttcagagggacctctacagagaagtgatgttagagaattatgggaacgtggtctcactgggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaa

SEQ ID NO: 909 - DNA, 2740 bp, Homo sapiens
gctgttcgcgctcatccccctcccccggccctgggtgtccccgtgacgaggcagcgcggagccgccgcgggccgggcccatcccgccgcagcggcccggggccgagcaggggctaggcggggagggagcggcgcccagcggggcccggagcgtggccagaatggtgctggaaggaaaccctgaagtggggtccccccgaacctcagacctccagcaccgggggaacaagggctcttgcgttctctcctctcccggtgaagatgcgcagccaggcgaggagcccatcaagtatggtgaactcatcgtcctgggatgctgtgaggaaggaggtgaggaaaccgaggctcagagaggggaagtgactggcccaagggcacacagctgctacaatggttgtctggcaagtggggacaagggccgccggcgaagccgcctggcactgagccgccggtcgcacgccaacggggtgaagccagacgtcatgcaccacatctccacgccgctcgtctccaaggcactgagtaaccgtggtcagcacagcatctcgtatacactgtcccggagccactcggtcatagtggagtatacacatgatagcgacacagacatgttccagattggccgctccacagagaacatgattgacttcgtggtaacagacacgtcccctggaggaggggctgccgagggcccttctgcccagagcaccatctcccgctatgcctgccgcatcctctgtgaccgccggccaccctatactgcccgcatctatgccgctggcttcgatgcctctagcaacatcttccttggagagcgagcggccaaatggcggaccccagatggcctgatggatggactgaccaccaatggagtcctggtgatgcacccggcaggcggcttctccgaggactcagccccgggtgtctggcgggagatctcggtctgtgggaatgtgtacacattgcgggacagccgctcagcccagcagcggggcaagctggtggaaaacgagtccaacgtgctgcaggacggctctctcatcgacctgtgtggggccacactgctgtggcgcacaccggcggggctgctgcgggctcccacactgaagcaactggaggcccagcggcaggaggcaaatgcagcgcggccccagtgccccgtgggcctcagcactctggccttccccagcccagcccgtggccgcacagcgcccgacaaacagcagccctgggtctacgtccgctgcgggcacgtccatggctaccacggctggggctgccggcgggagcggggcccccaggagcgcgaatgtcctctctgccgccttgtggggccttatgtgcctctatggcttggccaggaggccggcctctgcctggaccctgggccgcctagccatgcctttgcaccttgcggccacgtctgctctgagaagactgcccgctactgggcccagacaccactgccccacggcacccatgctttccatgccgcctgccccttttgcggggcctggcttaccggcgagcatggctgcgtccgcctcattttccagggcccgctggattaggctccctggggccccctgctgctgtgcccacctgcccacccaggtccccacctcctgcagcccagagggagctctgcatgtgggacactccctgctggcacagccacaccagatggacatgttggatgggctgtgcccttccccccaactgtggccccccaaggaggtccccaagatctccaccccagtcatgctgatggggccttcagcaccagctctgtcctgggtcgatggaggaaagcccagccccatggccttgcccttcctggggcatcccacatcgtgccgccgacactgtgtgcccctgggggagtgaaggggccaggggcctttgacccccagcttaggctggctatgccctgagcctgccaacccagtttcagacactcatccttcatccttcctgctgccgccctgggttcctctataaacctcgctgctcagctgcccccacaagtcccacatgccccgcatgcgtgcaatgcctccagcccccaagtgagtggtgggtgggtggcaggctgggcctagcacttgctgatagccactatgggctcgactctgtgctaagtggtatctggggacacagaggcaatcagacctggttccccccctggtggagttcacagtctagtggaggacagactgttaacaaatggcaacacggcttcatgcgtgccaggatcagagtacaaatcaggctgtggcaggcctcactggtaatggaaaagtgagggaggcttcacggaggaggtgtcataggagctcagcctcaacggctgctcggaaccctccgagtccacaagatgggaagcaagtccacaagatgggaagcgtgctctatacagaagggagggcctgtgcacaggctcaggtgtcagtaagccagaaatccagggacagagtcaggatggctggagcatggactgcggggggaacagagaagggggtggagcaaaaggttgggaccatgtgaccagggaagatgctggatggaggattctgaacctcatttgtggacggtcaggagtcaacaaagggaggagagaggactcactggtcaagagtgtcggctgtgacacaagggccatcatccctgaatgcccaccatgtgccccgcactgtgctgatgatgataataataactacgtccattgagcactctccaga

SEQ ID NO: 910 - DNA, 7919 bp, Homo sapiens
ccagctcgcgctgcccgggcgggcgccggccgctggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgagggtatctcccagagccccagctggtgtggccaggccccaggagtaggatggggctccccctacgagggccggtggcagccagaactgatacagcccccctggtctggggccaggacgccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggggggaactcacgcacagccatgattgcagccctgagccctgctgacatcaattacgaggagactctcagcaccctcaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggagacagagaagattatagctgagctgaacgagacatgggaggagaagctacgcaagacagaagccctgaggatggagagagaagcattgctggctgagatgggggtggccgtccgggaggatgggggaactgtgggcgtcttctctccaaagaagactccccacctggtgaacctgaacgaagaccctctgatgtctgagtgtctgctctaccacatcaaagatggcgtcaccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccaccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacagggagcttgtggcctgtttgttttgggttttcatggaggtgtaggttatataaggcaatggcacaggtcttaagcatacttatcagtgaagtattgtatgtgtgctctgtgcaggcaccacccagatctggatataagaatgtttccatcttgtcttcctgaacttcaccctcctgtctcttccttcagggtgcgcagcccgatcttttccccgctttttttttttgggagacagggtcttgctttgttgcccaggctggaggtacagtcttggctcactgcagcctccgcctcctgagtagctgggattacaggcatgtgccaccacgcccggctcattactgttttttttgtagtgacgaggtttcaccatattggccaggctggtctcgaactcctgatgacctcaagtgatccgcccaccttggcctcccaaagtggtgggattacaggtgtgagccaccgcgcccggcctcccctgctttcatgtttgcttacccagtgtctcagtctgtgccagcagcaccactgtctgttatggacaaagcacagaagcggggatgcgaggggaggtagagggaccgccagcctgtcaatgcttaactggctgttgctgacagatacagaaggatttgtggggtacagaggagttctgctttaagtcacctaacttacttgaaaggtctcccaagcagccagtttctcttgatagtgaatgggttgggcaagcatactgcgcttacctgattgttttcatcctggttgtgttacctgccttctggcaggctacatcattgttcccagtcgttattttatttgtgttaagactgtttgttggccaggcgcagtggttcacgcctgtaatgccagcactgggaggccgaggcaggtggatcacgaggtcaggagatcgagaccatcctggctatcatggtgaaaccccatctctactaaaaataaaaataaaaaaattagccgggcatggtggcgggggcctgtagtcccagctactcaggaggctgaggcaggagaatggcatgaacctgggaggcggagcttgcagtgagctgagattgcgccactgcactccagcctgggcgacagagcgagactccatttcaagaaaaattaaaaaactgtttgttgcctgcttgttttaatgttctggcttgaggcagcgagcccttgactatgccacattgccaggattttgcaggttagattgtactacagcactgcctttggcttgccagactctggagtccccacattttcatcctgttctcaggaaaacactttgacccacttgaagctctgagctactgcttcacagcttcctggggtcagtctccagccaaaaccatagatatcccaactgcagccaaaccacggctctgggcgaaggaacgattaggtttactctaggtttccacaccctgatgctcctgcctttactttgacacctctgactgccaggttttcacagacctgttgacagtgactcaagatctggaatgtaatggatggtttggcaacagtgtttgcttgagcagtttaaaatctggccagggagactcaatgtgagcaagaaaatgatagaataccaagttttctggaggtcagagggagctgagttgagtgttaccgagaatgctgtggggtttgagatgagaaaaatagcttgctaatttaaaagacggattatttttccctaaagaccttgacttatgtaaatgtatattatccataattttaaaaatccacttatggctgggcacagaagctcacacctgtaatcccagcactttgggaggctgaggcaggaggatcagttgagtccaggagttcgagaccagcctgggcaacatagtgaaaccctgtatctacaaaacatagaaaaactagttgggtgtggtggtgtgtacctgtagttccagctactagggaggtaggaagatcacctgagcccatggagattgaggctgtggtgagctgtgaaggcaccacagcactctggcctgggcaagagtgggactctctcaaaaaaaaaaaaaaaaaaaaatccacatatccagccttccaagtcagtctttaataatgtgcacgggccaggcacagtggctcacacccgtaatcccaacactttggaatattagggtgggagcatcacttgaggccaggaatttgagaccagcctgggcaacatagtgagactgccccccccatctctacaaaaaataaaaatcaaaaataatactgtgggcaaactttacttagattttattcagagtagtgcctgtttatttttcatctgtgctacctgtgccggcattccatatgcatttgatttagtctttaaagtaccccggtaaaataggtcttttgtctgcatttttcagatgggaagactgaggttttgtttatttatttttatttatttattttttgagacggagtctcgctctgttgcctaggctggagtgcgatggcacaatcttggctcactacaacctccgcttcctgggttcaagcgattctcctgcctcagcctcctgagtagctaggattacaggcgcccacaaccgcacccggctaattttttgtatctttagtagagacagggtttcactatgttgtccaagctggtttcgaattcctgacctcaggtgatccacccgcctctgcctcccaaaatgttgggattacaggcgtgagccaccacgcccagcctatttatttatttttttagaatcaagatcttgctatgttgcccaggctgaactcgaactcctgggctcaagcaatcctgcctcccaagccaagcagctggtactgcaagcatgtgccaccgtgcctggctcctgaagactgaggttggtttagattaatgagttgcccaaattcagacagttcttaagtggcaaagttaggattccaacccaggtcaacataactaaagcccaaaccccatctcacccctctaggccatcaagtattggctgggtgcggtggtttatgtctgtaatcccagcactttgggaggcggaggcgggaggactgtttgagctcaggagtttgagaccagcctgggcaacataacaagaccctgtctctacaaaaatatataaattagccgggtgtactggctcacacctgtagctacttgggaggctgaggtgggaggatcgcttgagcctgggaggtcaaggctgcggtgacctgtgattgcaccaccaggagaccctgtcttaaaaatgtatatataaaaataaaaagaacatcagacatcaccatcacctcgcttagaatccatggggccttctcctcaaattcaatcttcccaggcatttcatgaacttgcgtctagtttctgttccctctcaaattgcccaggctgtcctgtgagtgacagcagctatttcgtgggcctcctctggaatcatgagaagtcacccaaacaatctcagttttctagctcactccgtcttgacatttctacactgtcatccttggttttcttggaaattaatttgcttttcttcattgtctttctttggagctgctttccttttgttggttactattttatttttagcttctcacaccataccgacatatgttggttattcttttagacatgttttttgttgttgttgtcacctggaacttttgtatcttgaataaatttggggatcaaataca

SEQ ID NO: 911 - DNA, 4512 bp, Homo sapiens
tgtggaggaaagtgtgccatggcggagcctgtggggaagcggggccgctggtccggaggtagcggtgccggccgagggggtcggggcggctggggcggtcggggccggcgtcctcgggcccagcggtctccatcccggggcacgctggacgtagtgtctgtggacttggtcaccgacagcgatgaggaaattctggaggtcgccaccgctcgcggtgccgcggacgaggttgaggtggagcccccggagcccccggggccggtcgcgtcccgggataacagcaacagtgacagcgaaggggaggacaggcggcccgcaggacccccgcgggagccggtcaggcggcggcggcggctggtgctggatccgggggaggcgccgctggttccggtgtactcggggaaggttaaaagcagccttcgccttatcccagatgatctatccctcctgaaactctaccctccaggggatgaggaagaggcagagctggcagattcgagtggtctctaccatgagggctccccatcaccaggctctccctggaagacaaagctgaggactaaggataaagaagagaagaaaaagacagagtttctggatctggacaactctcctctgtccccaccttcaccaaggaccaaaagcagaacgcatactcgggcactcaagaagttaagtgaggtgaacaagcgcctccaggatctccgttcctgtctgagccccaagccacctcagggtcaagagcaacagggccaagaggatgaagtggtcttggtggaagggcccaccctcccagagaccccccgactcttcccactcaaaatccgttgccgggctgacctggtcagattgcccctcaggatgtcggagcccctgcagagtgtggtggaccacatggccacccaccttggggtgtccccaagcaggatccttttgctttttggagagacagagctatcacctactgccactcccaggaccctaaagctcggagtggctgacatcattgactgtgtggtactaacaagttctccagaggccacagagacgtcccaacagctccagctccgggtgcagggaaaggagaaacaccagacactggaagtctcactgtctcgagattcccctctaaagaccctcatgtcccactatgaggaggccatgggactgtcgggacggaagctctccttcttctttgatgggacaaagctttcaggcagggagctgccagctgacctgggcatggaatctggggacctcattgaggtctggggctgacaccccactccctgtttgacggcccagcctggacttggggagaatgactttcccttttttgccccataagggctagcataagctgaggtagaacttatctttaagctgcagcaaaatcaaggagtgacttttgtcccctctcctgttgaccctggtttagagccgttaaccacttggtgagttatgtgggtgttgttgccctgggtggcctgtggctccgtccacaagtcatgctgagttttgcagcctctgtgacttggagatgtcccttcacccctcccctttcaccaccatcctcttttcctcatggaaatgtctgctttatgaaactatgcacatattgaaagtgagttgaaacaaatgagggttgggtaggagcttccaggcctgggatttacaccacgcctagcccagcagaggccttagtcccatttggggcttgggagtgacatttgcttgaggcttatacactggtgtggttgcctggcttgcaggaaatgaccaagctcacacatgctggctgaagcgtaagcagacaactgaggtactcttttgaaggatgaaggtggtggattctcagccctgggggtcttcctcacctgaggacccttcagagccaccctttctagtttgcatttcctggtgcacacatttaaggcataacagcacattcatccctttggtttgggatctcaggaatacagtcccatgcaaagattctctggttttatggcttttttccctttctttacaccatcctctcccataagcacccatgtctttgaatatgaatgtatttgtaaaataccacgtttcatgtgtgaatatgtgcttttactgtacatagtgctattgtgcaataggtcttatgctgttttcactcaatgtgtgctaagatctagccccattgactcttctagaaatgcagtattgctttgacctgccatgtggcactccacaatgtcaattgcagtttacacacattgcctaaagtgggggacacctgggtgcccctgaccccttggcaccggatacaggccacgataaacatcctttcgtgtgttcccttctgtgcttgtgtggcatgtgtacccaggatgggcctataggtcacagaggtcagtttctctttggttttccagattttctttagaacggtgactgaccctcctacttgaggccgcccttttctccttatccttgccagcacttgtattgccagactacctaatttttgccagtctcatgggtagatagtggtgcagtgctttaacatacattcatctgatcagcattaatttggggaattttttcacttagcctttctggtttcccttcctgtgcattgcccattttctcatggagtttcttatcttttttggtttattctcaggagttgcttgtacattcttgggcaattgcagataattccaagaatgcatatttgggctgggtatggaggttcactggtaatcccagcactttgggaggcccaggcagaaggatcgctgcagcccaggagttcgagactagcctgggcaacatagcgagacctcgtctctacaaaaaaaaattaaaaagggggctttgggaggccaaggcgggcagatcatgagggcaggagattgagaccctcctggccaacatggtgaaaccccgtctctactaaaatacaaaaaattagctgggcatggtggcgcacacctgtagtcccagctactctggaggctgaggcaggggaatcgcttaaacccaggaggcggagattgcagtgagccaaggttccaccactgcactccagcctggcgacagagcaaggctccactcaaaaaaaagatttaaaggggaaaaaattgaaattttctttgtatctaggggtatccgtcactgaacagaaattcttaattttggctaggcgtgatggctcaggtctgtaatcccagcactttcggtggccggggtgggtggatcacttgaggccaggagttcaagaccaccctgaccaacttggtgaaatcccatctctactaaaaatacaaaaattagctgggtgcagtggcgcatgcttgtaatcccagctactcaggaggcagaggcaggagaatcacttgaacccgggaggtggaggctgcagtgaacagagacagtgccactgcacatcagcctgagtgacagagagactttgtctcaaaaaaaaaagaaaattttaattttaatgtagacagtatgaattatcttgttctgcagttggttgctttttgattgcttatttaatagagttgttaagatattttacatcttctcctgttagctgttcagcttttcctttcatattgagaacactacacagtgctgaagtccagctggtacacaccggggtgacaccttggctgcatctgttctcaacagtcagacacttcttctaattggttgatgctgggctgtactggttgctaaatattgcacatcattttaaaactatttgagatgcacttttgtactcaggaggccaaggcaggaggattgcttgagcccaggagtttgagaccagcctgggcaacacagcgagaccttgtctcttaaaaaaaaaaaaaaaaaaaaatgagagaaatcggctgggcatggtttctcatgcctgtaatcccagaactttgggaggctgaggcaggtggatcaccggaggttaggaattcaagactgaaaccttgtctctactgaaaatacaaaaaaaaaaaaaaaaaaaaatgagctaggtgtggtggcaggcgcctgtaatcccagttacttcgggaggctgaggcaggagaatcgcttgaacccaggaggcagaggttgcagtgagccaagatcgcgccattgcactccagcctgggcgacaagagtggaaactctgtctcaaaaaaaaaaaaaaaaattcagtgaaatacacctttatatatgagatccaagtttcactttttgtgatataatgagccagttttctcagtaatgtctactaaaaaaaaagccattaacctttctctaatatttgcatgattctaataaaagtatgtcaacttcttaaaatgttttattgaaatgtggcattcctttgaattttatgacattaaaataatccacgacatggtacagctcttcactttttcagctttttaaatgtccattaataagtttgaatacgttaaaattatatgtttaacctcaacaaaataaatggcaatatgttcaacttgt

SEQ ID NO: 912 - DNA, 2049 bp, Homo sapiens
gtctcactctgatgcacaggctggagagcagtggcgcgatatgggctcactgcaacctccgcctcccgttttcaaacgattgtctcagcctcccaagcagctggggttacacgcgtgcaacacgacgcccggctaatttttgtatttttggtagagacggggtctcgccatgtcggccaggctggtctcgaattcctgacctcaagccatccacccacctcgcctcccaacgtgctgagattacaggcgtgagccaccgcgcctgggaagtgcgggaggcctttttaaaaaatgtaaactcgcgtgctcaagaagccctatcggagggaaacacccagaagaggccaccctccaaacacagggtaaaacaggggtgacgcacagaggtaacgggaaagcaggaacgagcgagagcgtgcggtcccgtacctgcgcgtgcctgcgtgcgcgtccgtgcggccgcgacgccgccgccggtgcctctctttctagacgtgcgcgcgcccgcagctcgcccccctgaccgtaaagaggcccggctgtgtcgtgaaaggggccgcaacgcgcagagcgctggttgacggccgggactccattttgttcgccgttactctgcgcacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgacagtatggaactgtctgcattggaccctaaactggactagaagaggcatcttcaaggttcatacgttgtccagctgtaagttcatttgagtagcagacctaacaaatatttgaggtcagaaccctaccatgttaaaacaaacaaaaacttaccatgttaataaaagtattcatttgcttgaaaa

SEQ ID NO: 913 - DNA, 1993 bp, Homo sapiens
tcctctcctattatgcaaacccacaccatggatccagcagactactctggccccagcatgctgctccttgggatgatgggagaagggggaaacctgtgttttctcttggttttagggtatgggtctacttctttgaacattcgctcagatcgtaaggtaaccccaagaatcggcatcactctctggtctgggcgcctggatagtcacgcatggagtccgcgaggtgctggcgccggagcacgctgggaacgccgggctcccggccggcctgacccggaagggctggcgcatggtaaccccagcttccctagcaaccaagcaggcgcaagaagcaaccagccgcgctatccgctcccgttgctaccggaatgcctcttcaggttagcgattacagctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgtcttcaccttgtataaaaaagaagcggccatgtgggagaccctttctgtgacgggtgttgacaaagagatgatgcaaagaattagagaaaaatctattttacaagcacaagagagagcaaaagaagctacagaagcaaaagctgcagcaaagcgggaagatcaaaaatacgcactaagtgtcatgatgaagattgaagaagaagagaggaaaaaaatagaagatatgaaagaaaatgaacggataaaagccactaaagcattggaagcctggaaagaatatcaaagaaaagctgaggagcaaaaaaaaattcagagagaagagaaattatgtcaaaaagaaaagcaaattaaagaagaaagaaaaaaaataaaatataagagtcttactagaaatttggcatctagaaatcttgctccaaaagggagaaattcagaaaatatatttactgagaagttaaaggaagacagtattcctgctcctcgctctgttggcagtattaaaatcaactttacccctcgagtattcccaacagctcttcgtgaatcacaagtagcagaagaggaggagtggctacacaaacaagctgaggcacgaagagcaatgaatactgacatagctgaactttgcgatttaaaagaagaagaaaagaacccagaatggttgaaggataaaggaaacaaattgtttgcaacggaaaactatttggcagctatcaatgcatataatttagccataagactaaataataagatgccactattgtatttgaaccgggctgcttgccacctaaaactaaaaaacttacacaaggctattgaagattcttctaaggcactggaattattgatgccacctgttacagacaatgctaatgcaagaatgaaggcacatgtacgacgtggaacagcattctgtcaactagaattgtatgtagaaggcctacaggattatgaagcggcacttaagattgatccatccaacaaaattgtacaaattgatgctgagaagattcggaatgtaattcaaggaacagaactaaaatcttaatgactattagaagtaactaagtattgttataagttttttaaaaacaactggaggcatctttgtacatattatggccagttgtacagaatcgctttctgtttagtactttagttctgttgagggcaaaatattataaatctatagaaaataaactgtttgacttgaatcatttctgaataagtaaatctaaataagaatctattttaattccttatttcttcatattaatacatatgtatacttttttgtgttactgaattaagcttgcccttgtaacaaaatatgttttggtatagttaccaggacacttactgattaatttttaacaaggtagaattttaaaataaaagatttataaataa

SEQ ID NO: 914 - DNA, 781 bp, Homo sapiens
ggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgactccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatct

SEQ ID NO: 915 - DNA, 1801 bp, Homo sapiens
ctcaacagggcgtgtttttgtgtcactggtgtccctgagctggaggtgatctgtgggctgcagcaggcggaatggccccgtctgggattgagccacctgggagctgtcggcgggggttggggcggccttcccacctccacctgggtttctcttcacactcaggaggtagatctggcctcggaagtggccttagaggtggtgcggacagcagagcctggcgtgtggttggaggctcaggccccggtggccctggtggctcagcctgagcccctgccggccacagctggtgtgaagagggagagcgtgggcatggaggtggcagtgctgactgatgacccgctgcccgttgtggaccagcagcaggtgctggcccgtctgcagctgttggagcagcaggttgtgggtggagagcaggccaagaacaaggacctgaaggagaagcacaagcggcgcaagcgctacgcagacgagcgcaggaagcagctggtggctgccctgcagaactcggatgaggacagcggggactgggtgctgcttaacgtctacgactccatccaggaggaagtgcgggccaagagcaagctgctggagaagatgcagaggaagcttcgggcagcagaggtggagatcaaagatctgcagtccgagtttcagctggagaagatcgattacttggccaccatccgccggcaggagcgtgactccatgctcttgcagcagctcctggagcaggtgcagcccctgattcgcagggactgtaactacagcaacctggagaagattctgcgtgagtcctgctgggacgaagataacggcttctggaagatcccacatcccgtcatcacaaaaaccagcctcccagtagcagtttcaactgggccacagaacaaaccagcccgcaaaacctctgcagcagacaatggcgagccgaacatggaggacgaccgctacaggctcatgctcagtcggagcaacagtgaaaacattgccagcaactacttccgatctaagcgggccagccagatcctcagcacagacgccaggaagagcctcacacatcacaactcgccaccaggcctcagctgcccactcagcaacaactctgccatcccacccacccaggcccctgaaatgccccagccccggcccttccgcctcgagtccctcgacatccctttcaccaaggccaagcgtaagaaaagcaaaagcaactttggcagtgagcctctgtgagcacagctgcttgccattgcctgccttataggcatgtagagactgccaggccctcccagggcagccccaaccaggtctcctcccacctgccacacagcgctccggggcctgagggctccctcagccctgggaagacacattcccttccctgttccccagagagcccacctccgccctgggcaggagcccctcggaggctgtatagtcctccttagagaggcctgctccagctgttcataccacatcagtgtttccgtctgctcacctgccacagagcccacacccatgcccaccagtgttggtctttgcctcaaagcctgagacctgcttcacggccttcaccagccctgatggagagggcagcagctgccacgtggaggaagctcaatatcagctgggaaggaactgtgcctctgtctgactggccccacttcctaagcactgccctgccccatggggtggcacaggggtcccacagcaggtcttcctgcactgcccacccctggctggtctgtggcccaaggaaggccactccacattaagctgcccaataaactgcttttaagat

SEQ ID NO: 916 - DNA, 1546 bp, Homo sapiens
aatcccgtgcggcgcgcacaggcaggaggttgcagttgggcgctcagcagctgtggcagccggttgaggtctggcagtagcgttgggctgaagcagcggagttcgccatgcgcgagtgtatctctatccacgtggggcaggcgggtgtccagatcggcaatgcctgctgggaactgtactgccttgaacatggaattcagcccgatggccaaatgccaagtgataaaaccattggtggcggggacgactccttcaacacgttcttcagtgagactggagctggcaagcacgtgcccagagcagtgtttgtggacctggagcccactgtggtcgatgaagtgcgcacagggacctacaggcagctcttccacccggagcagctgatcaccgggaaggaagatgcagccaataattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacagcctccctgcgatttgatggggccctgaatgtggacttgacggaattccagaccaacctagtgccgtacccccgcatccacttccccctggccacctatgccccagtcatctcagctgagaaggcctaccacgagcagctgtctgtggccgagatcaccaatgcctgcttcgagccagccaatcaaatggtcaagtgtgaccctcgccacggcaagtacatggcctgctgcatgttgtacaggggggacgtggtccccaaagacgtcaacgcggccatcgccaccatcaagaccaagcgcaccatccagtttgtggattggtgcccgactggatttaaggtgggcattaactaccagccccccacagtggtccccgggggagacctggccaaggtgcagcgggccgtgtgcatgctgagcaacaccacggccattgcggaggcctgggcccgcctggaccataagttcgatctcatgtatgccaagcgggcctttgtgcactggtacgtgggcgaaggcatggaagagggagagttctctgaggcccgcgaggacctggcagctctagagaaggattatgaagaggtgggcgtggattccgtggaagctgaggctgaagaaggcgaagaatactgaggggagggtgtggtgggttctcccctgccacccccgggatggctgcttccaagttgtttgcaattaaaggttctgtataaaaccaa

SEQ ID NO: 917 - DNA, 2169 bp, Homo sapiens
aatgagatgctcgcctccgcgcgtttccgcttccgccatcgcggacgcagcctcgtgccgggagtcgccgcattgtggtccgcttctctgcactatgtcgggtggcctcctgaaggcgctgcgcagcgactcctacgtggagctgagccagtaccgggaccagcacttccggggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcacaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacagggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttattcggattgtcttctgtaataggtttcaataaagctggatgaactta

SEQ ID NO: 918 - DNA, 1800 bp, Homo sapiens
gtgtttccggctccgctgcggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctccttctgtgtcctctcttgcctctggcctttctctggggcacaggcctcttacggctgctgctgggaactgggagtttggcttctagcccagattctgccatgtgacctagggcacatccttgcccctctctgggcctcagtttctcattacttaaagattaaaacaaggcttggccgggtgtgatggttcatgtctgtaatcccagcactttgggaggctgaggggagcagatcacctgatgtcaggagtttgagaccagcttggccaacatggagaaacccagtctctactaaaaatacaaaaattagccgggtgtggtggtgcacacctgtaatcccagctactcgggaggctgaggcaggagaatcgcttgaacccgggtggcggaggttgcagtgagccgagattgcactacttcactccagcatgggtgacagagactccatctcaaaaaaataaataaa

SEQ ID NO: 919 - DNA, 2243 bp, Homo sapiens
ccaaagccctcttgggacaagccggggattccccgccgccgcccgccccctggcgtcacggagtccccgcgaggccccgccccggcctggcgccgtcctgggcgggaggaacgcgccgctaggcgggagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaggctgagctgctggacaagttctcaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgagatggcctaccaggtggtggagaagggcgcggccctgggcacgctggagtcggagctgcagcagaggcaaagcaggctggcagccctggaggcccgcgtggcgcagctgcgagaggcgcgggcgcagcaggcccagcaggtggaggagtggcgggcgcagaatgcggtgcagcgggcagcctacgaggcgctgcgcgcgcacgtcgggctccgggaggcggcactgcgcaggctccaggaagaggcgcgcgacctgctggagaggctcgtgcagcgcaaggcgcgcgccgcggccgagcgcaacctgcgcaacgagcgccgggagcgggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcaggtctgcctcagccacctccctgacgctgtcccactgtgtggatgtggtgaaggggcttctggattttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctcctcactttttctcccaaagtagaaaaaaatgatatctgaa

SEQ ID NO: 920 - DNA, 7550 bp, Homo sapiens
ggaagcggaagtgaagggtgcgcttggcggcggcggcgggagctgcggagtcgggaatcaaaacaaagggcctggggggggcggggggaaggcggcggggccggaatgtgagcggaggtggagccggcggcagagggtggaagaatgaaagaaaagaaagatgaaaggatgttgaatcactttgcatggctgtatgatggaaggaaacggaactgagaactcctgcagtagaacacgtggatggcttcaacaagataatgatgctaagccatggctttggaaattctctaattgcttttctcgtcctgagcagacgctgccacatagtccccaaacgaaagagtacatggagaacaagaaagttgctgtggaactaaaggatgtaccatcaccccttcatgctggctctaagctttttccagcagtcccacttcctgatattcgttctcttcagcagcctaaaatacagctttcttctgtccccaaagtaagctgctgtgctcattgccctaatgaaccctccacttcgccaatgcgttttggtggtggtggtggcggtagcggaggtaccagtagcttgattcacccgggcgcactgttagactcgcaaagcaccaggacaatcacgtgtcaggtagggtcagggtttgctttccagtctgcatcttcactccagaatgcctcagctaggaacaatttggcaggcattgcaagtgactttcccagcatgtgtctagagagtaacctgtcttcctgcaaacacctgccctgttgtggaaaactccacttccagtcatgtcatggtaatgtgcacaagctgcatcagtttccgagtctgcagggctgcacctccgctggctatttcccctgttctgatttcacaagcggggctccagggcatttggaagagcacatttcacagtcggagctaacgcctcacttgtgcaccaactctttgcaccttaatgtggtacctccggtttgtttaaagggctcactttactgcgaagactgtctaaacaagccagcaagaaatagcataatcgatgcggctaaagtctggccaaatataccacctccaaatactcaacctgcacctcttgctgtccctctgtgtaatggctgtggaaccaaaggaacagggaaggagaccacgttgttattggcgaccagtctaggcaaagctgcttcaaaatttgggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttggtaataggatcattgtgtcatttactccaaaaaatagagaactctgtgaaacaaagagttcaaatgcaattgctgataaagtgaagtctcccaaaaaacttaagaatccaaaattgtgcctcatcaaagatgcaagtgaacaatcttccagtgccaaagccacgcctggaaaagggtcacaggcaaattctggatctgctacaaaaaatacaaatgttaaaagtttacaggagctgtgccgcatggagtcaaaaactggtcatagaaacagtgagcaccagcaaggtcacctgaggctggtcgtacccactcacggtaactcaagtgctgcagtgtcgacgccgaaaaactcgggggtggcagaacccgtttacaaaaccagtcagaaaaaggagaacctcagtgcccgaagtgttaccagttctcctgtagagaaaaaagataaagaggagactgtattccaagtgagttacccgtctgcttttagcaagttagttgcatccaggcaagtcagtcctctgctcgcatctcagtcttggtcttctaggagtatgtctccaaaccttttaaacagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgagtgcagaaacaatgtctgttcttcaggatgcccctgcctgttgcctgcctctgtttaaatttacagatatctatgaaaaaaagtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagcgaacatgaatttgatccagactcttacaagattccttttgtgattctttctttgaagacatttgcgccccaggttcacagtcttctccagacccacgagggcaccgtgcctttactagacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggtctggataaaaggacatggtcataagagaattgtagtgttaaaaaatgacatgaaaagtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatct

SEQ ID NO: 921 - DNA, 785 bp, Homo sapiens
ggtggcgggtatgatctcaacctcttcgccagccctcctgacagcaacttcgtgtgctccgtctgccatggggttctcaagaggccagcaaggttgccatgcagccacatcttctgcaaaaagtgcatcctccggtggctagccagacaaaagacctgtccgtgctgtaggaaagaggtgaaaaggaaaaaggttgtccacatgaataaactccggaaaaccattggccgcctggaagtcaagtgcaagaacgccgacgctggctgcatagtgacatgccccctggcccatcgcaaggggcaccaggactcatgcccctttgagctaacggcctgccccaacgagggctgcacctcgcaggtgccgcgtgggaccctggcagagcaccggcagcattgccagcaagggtcccagcagcgctgccccctgggctgcggggccaccctggacccggccgagcgtgctcgccacaactgctaccgggagctgcacaacgcctggagcgtgcgccaggagcgccgtcggcccctgctgctgtccctcctgcggcgtgtgcgctggctggaccaagccaccagtgtcgttcgtagagagctggcggagctcagcaacttcctggaggaagacaccgctctgctggagggtgccccacaggaggaggccgaggctgccccagaaggcaacgttggggctgaggtggtgggggagcccagggccaacataccttgtaaataggtaaataaaagcagacccccggcctgcctgcctctgtgcctgcggccctc

SEQ ID NO: 922 - DNA, 882 bp, Homo sapiens
gttgcctaaacctctgccacccacctgtgaacttcactttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaagcatcacttataaggaagaggaggacttgacactccagccccgttcctgcctccagtgcgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagacctctgcccattggcacggccttctctgtgaccgtcgactcttcttggatatcccatatcaggccttggatcaaggcaaccgggaaagtttgactgcaaccctggagtacgtggaagagaagacaaatgtggactctgtgtttgtgaacttccagaatgatcggaacgacagaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatc

SEQ ID NO: 923 - DNA, 3250 bp, Homo sapiens
cgagtgttggcggggactgagcctcctgcttgaggtagttgtttttactcccagtccccaggctcacgagccccacgcgcgctcaatctgccctcccgcttctcctcgccactccgagttctgcgccctcgagatccagcgcatccgcggggtgggcgggtcctggcggctctttgccctcttccaacatggccgccgctgcctctgtgacaggcagggtcacgtgggcagcctcgcctatgaggtcgctggggctcggccggcgattgtcccttcccggaccccgtctcgatgcggtgactgccgctgtcaacccgagcctgagcgatcatggcaacgggctcgggcggggaacgcgtggcagcggctgcagcggcggcagtttggtggcggactggggcggcggagcggcggcggcggcggcggtggcactggcactggccccggccctgagcaccatgcggcggggcagctccgagagcgagctggcggcccggtgggaggcggaggcggtggctgcggccaaagcggcggccaaagctgaggccgaggccacagcggagacggtggcggaacaggtccgcgtggacgcgggcgcggccggggaaccggagtgcaaggcaggggaggagcagcccaaggtcctggccccggccccggcgcagcccagtgcggctgaggaggggaacacccaggtccttcagcggccgccgcccacgctgcccccgtccaagccgaagccggtgcagggcctctgcccgcacgggaagccccgggacaagggccgaagctgcaagcggagctcgggccacggttccggcgagaacggctcccagcggccggtcaccgtggacagctccaaggccaggacctccctggatgccctgaagatcagcatccgccagctcaagtggaaggagttcccatttggccggcgcttgccttgtgacatctactggcatggagtttcatttcacgacaatgacatattctccggtcaagtgaacaagtttccaggcatgacggagatggtgcgtaaaattactctgagcagagcagtgagaaccatgcagaatctctttcctgaggagtacaacttctaccctcgctcatggattctgcctgacgagttccagctctttgttgctcaggttcaaatggtgaaagacgatgacccctcctggaagcccacttttatcgtgaaacctgatggtggttgtcagggtgatggaatctacctcattaaagaccccagtgacatccgcctggcagggaccctccagagcaggccagcggtggtccaggagtacatctgcaaacctctccttatcgacaagctcaagtttgatattcgtctgtatgtcttactcaagtccttagaccccttagagatttatatagccaaagacggactctctaggttttgtaccgagccatatcaggagcccacccccaaaaacctgcaccgcatctttatgcacttaaccaactattcactgaacatccacagcggcaacttcatccactcggacagtgctagcactggcagcaaaaggactttttccagcatcctttgtagactgtcttccaaaggcgttgacatcaagaaggtctggtctgacatcatctccgtggtgattaagacggtcatcgcgctgactccagagctcaaagtcttctaccagtcagacatccccacggggaggccgggccccacgtgcttccagattttaggctttgacattcttctaatgaaaaatctgaagcctatactacttgaagtaaatgcaaatcccagtatgagaatcgaacatgagcacgaactttctccaggggtgtttgaaaatgtccccagcctcgttgatgaagaagtgaaagtggctgtgatcagagacactctgcgcctcatggacccacttaagaagaaaagagagaatcagtctcagcagcttgaaaaaccattcgctggaaaggaagatgctttggacggcgagctgaccagtgctccagactgcaacgccaaccccgaagcccacctgccttccatttgcctcaagcaggtgttccccaagtacgcaaaacagttcaactacctgcgcctggtggacaggatggcaaatttgtttatccggttcctgggcatcaaggggacaatgaagttggggccaacaggctttcgtaccttcataaggagctgcaaactcagcagcagcagcctgtccatggctgccgtggacatcctctacattgacatcacacggaggtggaactccatgaccctggaccagcgggactcagggatgtgtctgcaggccttcgtagaagctttctttttcctggctcagaggaagttcaagatgctgccacttcatgagcaggtggcctcactgattgacctttgcgagtaccacctgtccctgctggatgaaaaacgcctggtgtgtggccggggcgtcccgtcggggggccggcccccacaccgtggccctccccaggagccctccccctcggcccagccagcaggggacaaccccccaccccgcaccagctgtgccaataagctctcccatcccagacataccctgtcctgagggccactctgtcctcctggaaaacggaagacgagagcagctttcagggctggagcgccccaggcattctgcctgcagaggaatggcaggcaggctgccgaggggcccagctgaggtccccacgaactgtctctgtgtgcggctgagctgtgcttcaccaggctggctggttctcacctgccttcctcctcacacctcctggtgatacaccctgtttctgagtcatcagtcatcggacatatgacatctaaaacgtgacagatggcaccttctattctgggctcacaggaagcaccaactggggcaaatctgttgtatttggggcacaggacacaatcgatcccaaggcccggagctgtggagaggaagccgagtgttaggatctgctgccggggcctccacgcgcccaccgggaaaagcctgagaacatcgtgtttatttcctgccgcccgttccgagagaaggaagtggaaatatcaagtaggcatctgcgaatctcccatcccagtcatgtgctacatgggtgtagtgaacagattaacctcatttagttcattagcttgcctgttgctgcaatatttggtttgttattaattaagaaaaaattaattaagaagtaactaagactcctggagcctcagagctggcaggagcctcag

SEQ ID NO: 924 - DNA, 1081 bp, Homo sapiens
actacttctcccccggactccttggtagtctgttagtgggagatccttgttgccgtcccttcgcctccttcaccgccgcagaccccttcaagttctagtcatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattgatgaagttcgcactggcacttaccgccagctcttccaccctgagcaactcatcacaggcaaggaagatgctgccaataactatgcccgagggcactacaccattggcaaggagatcattgacctcgtgttggaccgaattcgcaagctgaaatcattctttgcaactaaaccccgcatccacttccctctggccacatatgcccctgtcatctctgctgagaaagcctaccacgaacagcttactgtagcagagatcaccaatgcttgctttgagccagccaaccagatggtgaaatgtgaccctcgccatggtaaatacatggcttgctgcctgttataccgtggtgacgtggttcccaaagatgtcaatgctgccattgccaccatcaaaaccaagcgtaccatccagtttgtggattggtgccccactggcttcaaggttggcattaattaccagcctcccactgtggtgcctggcggagacctggccaaggtacagagagctgtgtgcatgctgagcaataccacagctgttgccgaggcctgggctcgcctggaccacaagtttgacctgatgcccttgagaaggattatgaggaggttggagcagatagtgctgacggagaggatgagggtgaagagtattaacctgtgtgctgtacttttacactcctttgtcttggaactgtcttatttttgttctgtaaatgtctattgccgtaaattgttaataaaattgaagtttccattttaa

SEQ ID NO: 925 - DNA, 2103 bp, Homo sapiens
gcagcggaagccggaagcggcgagcggggtcgttctgggcctaggggaggcgggccgagggcgtctgagctgaggcccgcgtcgatcctgggttggaggaggtggcggccgctgaggctgcggcgtgaagacggcgggcatggtggggcgggagaaagagctctctatacactttgttcccgggagctgtcggctggtggaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggatccatcaattaagggaacctttcactggtctggcaatgaacagatgactaagtatgaaatggcatgtgcaattgcagatgccttcaacctccccagcagtcacttaagacctattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaattaa

SEQ ID NO: 926 - DNA, 752 bp, Homo sapiens
gccaaccggctcccacatatctgcacacacttaaatacaaaggccgggaagggtcagaccaccatccgggtactctaagtcctccctcccccttctccttcacccccaagtgtctcccacgactgccctccccgacctctagctgaccatggcatcagaggcagaaaaaacattccatcggtttgctgcgtttggagaatcatcaagcagtggcactgaaatgaacaacaagaacttctccaagctgtgcaaagactgtggcatcatggatggcaagacagtcacctccacggacgtggacatcgtgttcagcaaagtcaaggccaagaacgcccgaaccatcacgtttcaacagttcaaagaggcagtgaaggaactgggccagaagcgcttcaaagggaagagtccagatgaagtcctggagaacatttatggactcatggagggcaaagacccagccaccactggcgctactaaagcaacaacagtgggtgcagtggaccgtttgacagacaccagcaagtacaccggcacccacaaggagcgctttgatgagagtggcaagggcaagggcattgcgggacgggaagagatgactgacaacacaggctatgtgagtggttacaagggttctggcacctacgataagaagaccaagtagagaggagcttcatctcagcctgctagccccctgaccctgcatgtttaacaccagggagcttggaaaacaataaacatctgtgtgtgcagca

SEQ ID NO: 927 - DNA, 4024 bp, Homo sapiens
caggagggatggactcctggactctccagctacctgcgtggtcctccccggtgtgaggacagaagaccggtcctgggccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaata

SEQ ID NO: 928 - DNA, 11292 bp, Homo sapiens
cgccccccctgcgcccgcccctcccccttcgctttccttctccccccgcctcggctccgacatgaggggccggcggggcaggccgcccaagcagcccgcggctcccgctgcggagcgctgcgccccggccccgccgccaccgccgccgccgcccacgtccggacccatcggggggctccgctcgcggcaccgcggcagcagccggggcaggtgggccgccgcccaggctgaggtggcgcccaagacgcggctgagctcgcccagggggggcagcagtagccggaggaagccgccgccgccgccgccggccccccccagcaccagcgccccgggccggggggggcgaggaggcgggggcggcaggacggggggcgggggcggcggcggccacctggcccggaccaccgcggcccggagggccgtcaacaaagtggtgtacgatgaccacgagagcgaggaggaggaggaagaggaggacatggtctccgaggaggaggaggaggaggacggcgacgccgaggagacccaggattctgaggacgacgaggaggatgagatggaagaggacgacgatgactccgattatccggaggagatggaagacgacgacgacgacgccagttactgcacggaaagcagcttcaggagccatagtacctacagcagcactccaggtaggcgaaaaccaagagtacatcggcctcgttctcctatattggaagaaaaagacatcccgccccttgaatttcccaagtcctctgaggatttaatggtgcctaatgagcatataatgaatgtcattgccatttacgaggtactgcggaactttggcactgttttgagattatctccttttcgctttgaggacttttgtgcagctctggtgagccaagagcagtgcacactcatggcagagatgcatgttgtgcttttgaaagcagttctgcgtgaagaagacacttccaatactacctttggacctgctgatctgaaagatagcgttaattccacactgtatttcatagatgggatgacgtggccagaggtgctgcgggtgtactgtgagagtgataaggagtaccatcacgttcttccttaccaagaggcagaggactacccatatggaccagtagagaacaagatcaaagttctacagtttctagtcgatcagtttcttacaacaaatattgctcgagaggaattgatgtctgaaggggtgatacagtatgatgaccattgtagggtttgtcacaaacttggggatttgctttgctgtgagacatgttcagcagtataccatttggaatgtgtgaagccacctcttgaggaggtgccagaggacgagtggcagtgtgaagtctgtgtagcacacaaggtgcctggtgtgactgactgtgttgctgaaatccaaaaaaataaaccatatattcgacatgaacctattggatatgatagaagtcggaggaaatactggttcttgaaccgaagactcataatagaagaagatacagaaaatgaaaatgaaaagaaaatttggtattacagcacaaaggtccaacttgcagaattaattgactgtctagacaaagattattgggaagcagaactctgcaaaattctagaagaaatgcgtgaagaaatccaccgacacatggacataactgaagacctgaccaataaggctcggggcagtaacaaatcctttctggcggcagctaatgaagaaattttggaatccataagagccaaaaagggagacattgataatgttaaaagcccagaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgaggagccaacagaagttggggataaaggtaactctgtgtcagcaaatcttggcgacaacacaacaaatgcaacttcagaagagactagtccctctgaagggaggagccctgtggggtgtctctcagaaacccccgatagcagcaacatggcagagaagaaggtggcatctgagctcccccaggatgtgccagaagaacctaacaagacatgtgagagcagtaacactagtgctaccactacctccatccagcctaatctggaaaacagtaacagcagcagtgaactaaattcttcccagagtgaatctgctaaggcagctgatgatcctgaaaatggagaaagagaatctcatacacctgtctctattcaggaagagatagtaggtgatttcaaatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtactggtagttaactctcaaggagaaatttcacggttgagcaccaaaaaggaagtgatcatgaaaggaaatatcaacaattattttaaattgggtcaagaagggaagtatcgcgtctaccacaatcaatactccaccaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaactgggcatcacatagggcaaattggatcaaggcagttcagatgtgtagcaaacccagagaatttgcattggctttagccattttggagtgtgcagttaaaccagttgtgatgctaccaatatggcgagaatctttaggacataccaggttacaccggatgacatcaattgaaagagaagaaaaggagaaagtcaaaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccagtaagagtaaaacaaaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccaccacgggaggcacactggttacatctatgactgtgagcaaagagtattccacacgagacaaagtgaaactgatgaaattttcaagaccaaagaagactcgttcaggtacagctctgccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtacagtcttcaactcaaactctttcatcaggacaaactttaaatcaagttactgtttcatccccatcccgtcctcagctacaaatacagcagccacagccccaagtcattgctgtgcctcagctgcaacaacaagtccaggttctctctcagatccagtcacaggttgtggctcagatacaggctcagcaaagtggtgtgccccagcaaatcaaactccagttacctatccaaattcagcaaagcagtgctgtgcagactcaccagattcagaatgtggttacagtgcaggcagccagtgtgcaagagcagttgcaaagggttcagcaactcagggatcagcagcaaaagaagaaacagcaacagatagaaattaagcgtgaacacaccctccaagcttctaatcaaagtgaaatcattcagaaacaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaaattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcgtttttattggtcataacagtccaattatattcttggccaattttgtccaacggacaagaaaaaagcaaagtcaacgacaccattatcttgtcaagatcagatggttttactattgtggcagaagcgagaaaactttgtttattgaaaaaaaaagaaaaagaaagcaagaaaaaaagatactatggggtcaagtgtaactccatggaaatgccacgtctgctcttcagtgaagaagctggtttagagtctcacagaaaacttttgactgtatttatttattgttgcaaaaaagacgcttttttattgctgccctcatttgtcagctaattattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaaatgagtaaaatctatttgaaggtatcttgtttgtaaacatttgtcagattctaatttttttcttttgtattaaaattcaactatggatgtatatgaaacaaaataaatggagataatttttctcccacagacagaggtgtctttgaatgtgcgctaatgattatctgtaagcctttgtggggagggaggcctgcaaggtcatgaaaggcagaagagtctaattgtgcctggatttctccaggacagcagtggcccctcgttttatcattcccagtccattgtcatcacgtcagagaaaaatcttcaggggtgctaatcctgttgcatcagttgatcatactaacgagaacggtaatgcgacaagatacacattgccttcatctgtacattctgtgataccaggcaaattaccaattacacacagctacttatattttatgaagggcattttttagatgacctcatcctctgtgttatttgttgattgggtttgttttctgtttgttggtttgtttgtttcttccacgtaaggaaaagtagtgtaaacagtagcgagaaaatggaaaccacagaggaagatgtattttgcatgtttttcctttcagtgttcttacacgttgtatcactgcattgtggtaatagcttctataaaatctgccatagttggattatgcagctttgcaaaaatttttactagattttgcactaactcatattagctttgtcctaccaacttctggaatttatctaattattgtttttcaaagtttctttccttttaatgtttccctgctatgcaaaacctttcccagacctcagtttcttaaaagaaagatgttgctacagttcccgattctttcttattacaggctcaggtgtacaggttattctgggttaattttatctaatgaagcccattcctttttgtacataaagatgtcacttaaacttatgcttacaaactaaagactaatcgctcaatatgaaaacatgaaaaaatttttgcttaaagtattaagatggaagtagttaaatatgggttattttgtccttttacttttttaaaaaatgttacatattgtatgcactgtgctgatgcaagaattctacattttaatgagttataaaattattctgcatctcatcacgtcacagtatttctgtactatttattcatatatataaatatatatgggcttaatcatttaaaatttgttgcagcaagaactttcctacctgtaggcaatagattgctatgtttttaacaaattgtggcaaattctaaacagcaattcttttgtacgtaataggacatttcatcctagaaaaataaagtaatgtttttgacattgga

SEQ ID NO: 929 - DNA, 2461 bp, Homo sapiens
gcgcgcagtttcccgcatgctcagtagctgaggtagggatgccatccttctcaaaagacttattgacagtgccaaagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtaggaggagcaggaaataagattattcagctgattgaaggcaaagcctctgcttatgtatttgcaagtcctggttgtaagaagtgggatacttgtgctccagaagttattttacatgctgtgggaggcaagttaaccgatatccatgggaatgttcttcagtaccacaaggatgtgaagcatatgaactctgcaggagtcctggccacactgaggaattatgactactatgcaagccgagttccagaatctattaaaaatgcacttgttccttaaaggaaagtttcatttggccgggcgcggtggctcatgcctgtaatcccagcactttgggaggccgaggcaggtggatcacttgagctcaggagtttgagaccagcctgggcaatatcgtgagaccccatctctacaaaaatacaaattaactgggcatcctgtcatgcgcctgtcatcccagctacttgagaggctgaagcagaagaatctcttgagcccggaaggcagaggttgcagtgagctgagatcgtgccactgcactccagcctgagtgacaggagttaagccctgtctcagaaaaaaaaaaaacaaaaacccaaaaagtacttaaagtttcatttacttagctaggagaaagacttggttctcaaaataatacattttaagattaattgggtagaattagagttccacctttattcattgttgagcagtgatttatatttagttattatatttaggaatagaaaatagaattaaataatttaacttgattaatcaaccagaccaattttgacgtctggagaacttataaactcaatatgttatatttgttttcctgtatttaggtggagaaatgagaaaaagctttagttccaattgacagttcaggtcaatgttcaatgaacattcctatcttctaaaccagatttctctttttttttcctgagacggagtctcgctctgtagcctaggctagaatgtagtggcgtgatctcggctcactgcaagctccgcctcccgggttcatgccattctcctgcctcagcctcccgagtagctgggactgcaggcaccgccaccacgcctggctaattttttgtatttttagtagagaaggtgtttcaccgtgttagccaggatggtcttgatctcctgacatcgtgatctgtctgcctcggactcccaaagtgctgggattacaggtgtgagccaccgcacctggcctaaaccagatttctttagggcacaattttttctggaatctcactcttgtttttcacagtaattttaaaaacgtttctactccaattaagaatatatatgatgttattatatatgcttatgaaacagatttatgagaaaagttttttttaaataaattatttaatcctagctctttgttattcaccagctttttaaaaaagtgtttgaaaattatacattctcgactttggggattagtttattcttgtggcatcattataaggcttaattgtggaaagctaagtacttgcttctattccttccaatgagagattataacataaactattaaaattattctgctaatatacctagatttttatttttaggtctctgtccattgcttttaattaaaattatctgttttcaaatcaa

SEQ ID NO: 930 - DNA, 1964 bp, Homo sapiens
cctctggagtccctgtggcagaactcaaatggaaggaggagcagctgcacccaggggagcagggtgtcacctccgttggatagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 931 - DNA, 716 bp, Homo sapiens
tttccggttagcgcggcgtgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttccctc

SEQ ID NO: 932 - DNA, 6455 bp, Homo sapiens
ccccccacggtcccgccccttcctaccttccagtagccggcggcggtgtctcaggcggcaatggaaggatccgagcctgtggccgcccatcagggggaagaggcgtcctgttcttcctgggggactggcagcacaaataaaaatttgcccattatgtcaacagcatctgtggaaatcgatgatgcattgtatagtcgacagaggtacgttcttggagacacagcaatgcagaagatggccaagtcccatgttttcttaagtgggatgggtggtcttggtttggaaattgcaaagaatcttgttcttgcagggattaaggcagttacaattcatgatacagaaaaatgccaagcatgggatctaggaaccaacttctttctcagtgaagatgatgttgttaataagagaaacagggctgaagctgtacttaaacatattgcagaactaaatccatacgttcatgtcacatcatcttctgttcctttcaatgagaccacagatctctcctttttagataaataccagtgtgtagtattgactgagatgaaacttccattgcagaagaagatcaatgacttttgccgttctcagtgccctccaattaagtttatcagtgcagatgtacatggaatttggtcaaggttattttgtgatttcggtgatgaatttgaagttttagatacaacaggagaagaaccaaaagaaattttcatttcaaacataacgcaagcaaatcctggcattgttacttgccttgaaaatcatcctcacaaactggagacaggacaattcctaacatttcgagaaattaatggaatgacaggtttaaatggatctatacaacaaataacggtgatatcgccattttcttttagtattggtgacaccacagaactggaaccatatttacatggaggcatagctgtccaagttaagactcctaaaacagttttttttgaatcactggagaggcagttaaaacatccaaagtgccttattgtggattttagcaaccctgaggcacctttagagattcacacagctatgcttgccttggaccagtttcaggagaaatacagtcgcaagccaaatgttggatgccaacaagattcagaagaactgttgaaactagcaacatctataagtgaaaccttggaagagaagcctgatgtaaatgctgacattgtgcattggctctcttggactgcccaaggctttttatctccacttgctgcagcagtaggaggtgttgccagccaagaagtattgaaagctgtaacaggaaaattttctcctttgtgccagtggttatatcttgaagcagcagatattgttgaatcactaggcaaacctgaatgtgaagaatttctcccacgaggagatagatatgatgccttaagagcttgcattggagacactttgtgtcagaaactgcaaaatttaaacatcttcttagtagggtgtggagccataggctgtgaaatgttgaaaaattttgctttacttggtgttggcacaagcaaagagaaaggaatgattacagttacagatcctgacttgatagagaaatccaacttaaatagacagttcctatttcgtcctcatcacatacagaaacctaaaagctacactgctgctgatgctactctgaaaataaattctcaaataaagatagatgcacacctgaacaaagtatgtccaaccactgagaccatttacaatgatgagttctatactaaacaagatgtaattattacagcattagataatgtggaagccaggagatacgtagacagtcgttgcttagcaaatctaaggcctcttttagattctggaacaatgggcactaagggacacactgaagttattgtaccgcatttgactgagtcttacaatagtcatcgggatcccccagaagaggaaataccattttgtactctaaaatcctttccagctgctattgaacataccatacagtgggcaagagataagtttgaaagttccttttcccacaaaccttcattgtttaacaaattttggcaaacctattcatctgcagaagaagtcttacagaagatacagagtggacacagtttagaaggctgttttcaagttataaagttacttagcagaagacctagaaattggtcccagtgtgtagaattagcaagattaaagtttgaaaaatattttaaccataaggctcttcagcttcttcactgtttccctctggacatacgattaaaagatggcagtttattttggcagtcaccaaagaggccaccctctccaataaaatttgatttaaatgagcctttgcacctcagtttccttcagaatgctgcaaaactatatgctacagtatattgtattccatttgcagaagaggacttatcagcagatgccctcttgaatattctttcagaagtaaagattcaggaattcaagccttccaataaggttgttcaaacagatgaaactgcaaggaaaccagaccatgttcctattagcagtgaagatgagaggaatgcaattttccaactagaaaaggctattttatctaatgaagccaccaaaagtgaccttcagatggcagtgctttcatttgaaaaagatgatgatcataatggacacatagatttcatcacagctgcatcaaatcttcgtgccaaaatgtacagcattgaaccagctgaccgtttcaaaacaaagcgcatagctggtaaaattatacctgctatagcaacaaccactgctacagtttctggcttggttgccttggagatgatcaaagtaactggtggctatccatttgaagcttacaaaaattgttttcttaacttagccattccaattgtagtatttacagagacaactgaagtaaggaaaactaaaatcagaaatggaatatcatttacaatttgggatcgatggaccgtacatggaaaagaagatttcaccctcttggatttcataaatgcagtcaaagagaagtatggaattgagccaacaatggtggtacagggagtcaaaatgctttatgttcctgtaatgcctggtcatgcaaaaagattgaagttaacaatgcataaacttgtaaaacctactactgaaaagaaatatgtggatcttactgtgtcatttgctccagacattgatggagatgaagatttgccgggacctccagtaagatactacttcagtcatgacactgattaatacaagttgtcttaacgttactccaggaccacttgattttggaaagagtgcacttaattcagaagctaaagaaaatcagttcataatactatggatttctctttcattaagccttaattttaagggaaacatcagtaagaaactgcactgaagaattataaaacattttggggcatagcatacacttgtctaacggttcacacgtggctatgatcacaagcaactttgaactggaatgctatttacaaaagttttgtgtattaatctgtgtattaatctctctggataaaaagaaggaaaaaatatgtatgaccagaacagatatggatgaagaaattgaaagcaacgaatgcaactattcaaaaagtttaattttatgaatttcttttttgtttagtcttgaagactgattttctatgcaaatagtgtttggcatcctgcacctctgatatgatttggctttgagaatttaataccactgggaagaagtatggtagtggtggatgaagggtggatattttaaattgtgcagttacagtttactgtcctattacctctgctcgtttaaccagtttgttatatcactgtgtccccaaaatcaggatttttgttgatagcatcagtgttgtaggagcaataggtcagatgagacatattaacttagactaaacgtgaacagtattatatggactctcacaacgctcttagagaatccgtgaatgtgaacagacaaatgtggctaaccatttgattcttcagtatgccttctaatgtggctattttatttatgtgagactctaaacctgattgtcctaatatataaaactaaaagattttgtaaagggagtgtctttagaaatagatgaaatgtagaatgttaaaaattattgctagggtagtcttttttttttccagaaacctaattagggtattaaattttgtgttttttttgttttttttttttaaacagaagcatgttatttcattcccattcccagaaagggagttaatgaagataaaaatttattttttaaggtctttattgagagaaactttgttttctgatatgaactattgcagatgtttttataaatactttcattaaaatgatgtaaacagtagtacccaacactgtaaactcagtgaaaatagtaaatgattcttttattactaagactgtcatgcattctgaagcagttggcttttttttaaccataggaagtaatttccctctagctcctttccttctactctcctgctcagaccattagtaggtactttgttaaataaaaaactagattaacatcaatattactccaatttggtatcttttacactatgtattatacctactttctttttatttcatttacaaatagtttaaattactttatcaaccagctgtattgtttccctcttgtaaaagtaccatcaagtggggaaaatgtatgtggaagtggagagtgaatttgtatgactaaaggataatctgtacatggggaagtgggcaaaagtggataggatgaatttaaagaaaatgactacctttggaaaaaagaaattaaattttgttcacatatcctaccctttcccattgtgcatatcccaagtgtcatatttaaaactaaggttacttaaaacagaatccaggaatatcaaggctctgtggcttggaattttagaggataggactaataaaaggacttttgcaaagaaggcttttttccacgttcactttgttttgtgttctttgaaagtaactgatacttttcgggtagttaattcagcagtccataaatatgatccagtaacttgcttatattttattgaagtctcgacagctcttcagaagtaaatttagaacgatgctgtcagttcatatttatagatattagtgttttagcagataaaacaaaatcaacaaaaattaagttcattttgtgattaaacctgcaaccatttttccattactttttttctatagttaatggttattgccatgatttcttctgtttggttctactaagctagaaagccagggtgaagttaatgataattcccattattttatttctgtaccatgagattgctgttgatgactgaaataccaggtgcaaaaattaatgatttgatttttgtacagtttcaatgagtattttttacttattaaaaataaattaagaaatgtaagaatatctttgtaaatcatgtttcataagttgactccagagattctgattttgctgtttattttgtgagtaatgttgctttggtgtttcctgattttcaagtttgcaatcatggagatacagcagttattaggtgtggaaggacattacctcaaatgtcctcagatggctccaggaaattcttttaaaacagttggagagaaatagtcgtgaccatgtaaaacctagaggatctggtaaatcccatactactggttagggatttgtaaagtccatttctttttagagttcaaagcagttctgttacttgtccataagttcctcataaattgtcccaaaggtaggacatggaaataaatgtatatctttattttttaatctactatgtcacactctggtgatattcatggaacattaaaaaagcaactatgtttattttataattagtaaaatgaagatagaaaattgttcttttgaaatttttagggaaaaaaaaaatctcgtgacctaaatctttccactataatgaatattcattgtgattgcaaatatctaattttatataatcactgtgtatggatttagcgattttacttttcatagattcaaaaacatataatctgaatgctttctctgaaaaaaaaaaaatcagagttgagctcttgaggatcagagttaagtatccattgataatatgtgttcattttgctctatgtcataactttgtttttttattgagaaatatatatttttcaaaaacacatatatattcaaaaatacataaaatataaatatgcagttcaaggaataattttaaagcaactatataactagcactcagcttagtagaatatattgacagcagttcagaaattacacatgtagttccttcccagtcacaaccagctccctgccacgtaccctttggtaattaccactatcctaccttgtatgataattgtctctttgtttttatagtgttaccacctatgtgtgtaaacttaaacaatacagtttgcttgtttttgagttttatttaaaatcata

SEQ ID NO: 933 - DNA, 7732 bp, Homo sapiens
ttcaaaccaaaacaaaaagattaaaggagcagcggccggggcggcagcggtccccaggccgggacacccggggtggtgcgcccgggttcgcgggggctgcgccggcgccggggaggcggggggagcgggagcgggcgacgcggggaaggggggagccagggggagggcgccggccggaggaggggcggacccgcccgccctagccgagcagagcacagccgagccgagcggcccgggcgggggccgaccccggccagcgtcggcgcagagagcgggcggaggcgcaggccatgctgcggctggtgcccaccggggcccgggccatcgtggacatgtcgtacgcccgccacttcctggacttccagggctccgccattccccaagccatgcagaagctggtggtgacccggctgagccccaacttccgcgaggccgtcaccctgagccgggactgcccggtgccgctccccggggacggagacctcctcgtccggaaccgatttgttggtgttaacgcatctgacatcaactattcagcaggccgctatgacccctcagttaagcctccctttgacataggtttcgaaggcattggggaggtggtggccctaggcctctctgctagtgccagatacacagttggccaagctgtggcttacatggcacctggttcttttgctgagtacacagttgtgcctgccagcattgcaactccagtgccctcagtgaaacccgagtatcttaccctgctggtaagtggcaccaccgcatacatcagcctgaaagagctcggaggactgtcggaagggaaaaaagttttggtgacagcagcagctgggggaacgggccagtttgccatgcagctttcaaagaaggcaaagtgccatgtaattggaacctgctcttctgatgaaaagtctgcttttctgaaatctcttggctgtgatcgtcctatcaactataaaactgaacccgtaggtaccgtccttaagcaggagtaccctgaaggtgtcgatgtggtctatgaatctgttgggggagccatgtttgacttggctgtagacgccctggctacgaaagggcgcttgatagtaatagggtttatctctggctaccaaactcctactggcctttcgcctgtgaaagcaggaacattgccagccaaactgctcaagaaatctgccagcgtacagggcttcttcctgaaccattacctttctaagtatcaagcagccatgagccacttgctcgagatgtgtgtgagcggagacctggtttgtgaggtggaccttggagatctgtctccagagggcaggtttactggcctggagtccatattccgtgctgtcaattatatgtacatgggaaaaaacactggaaaaattgtagttgaattacctcactctgtcaacagtaagctgtaaaaacagaacaatgacataaatcaagggagaaagaaaatgggcactttatgtctcagaattactcaaatcaatttatttttagttggtaatggatataatatttcttaaaacaaaagtaaggtgttaatgaataggtctctccttctcctcctcctcctcctcttcccttgggggaaaaaaaaaaatgtgctaataaaacttccctccatggctaagagggaaaacgcttacattcaattctttagtcatggatggtctcgttccagatgttattgttccagggaactaaattcattcctgatgccagatctgatcgagtcagtatgtcttcagcttgatcagattttaaaatcagttttgaaagtggttcccgacttctttgctttgggagaatttggtcttatgctcataagcagttcatgagtgacaagtgtagcaaaagccagccatatattttcagaatctatatcctcaggaaatggtcctttttttttctataaatcaccaaccaactatctaaatggacatttgggggaattccctcccaaatttgattttgttattagaaaaatgattccgtgaacacagatgtgttttgaagaagtagcacgtaatggcttttatctaccatcaacctgataaggcacatgtgaaatggaaatgttctctttcctctgaagcagcaaattaatgttgaaaacttacatagacagaaagtaggttttggaaagggaaaccacagagattagggggacttaaaattaatataggcacaggaaagagaaaagtgtgcgctccattctcagtgggggttcaccacaaaacacgggccccaggagggaagcgctgtctaggcacacggcaaggccttagtaacagcatgctacactgctcgaggtacggtatgtcccatcgccctgtgcaccgtagagacctcagtcatctcaaggaagaatacatttgcttctccttagaggcgttcgaactagaagctatgcgttacctctgattctggaaacagaatagcagccactcattctgcattcccatttttctctccacgtgttctggtggaatgagatgctccttggcactatagcctgatgtcccacattgacccactgaccacacaggaaaagcagcgaaacctgcaccctctcttctgagtcacgcctgtggctcatcggcttccctcttaacctttagtgccctgaagactgctgccgctgtcaccgttgcgctgaaaccccatgggcccgttctgattgaaggtgaagcccaccagattatttttcaaagtcttaggtttcggtgtatctaacctgctcagtaaatatggacgcaattaaagatgctctaggaaatttggggactgtatttaatttttctttccttccatctgaggagcaaggaaatcctactgctgaatagctgttagtatctattttacaagatttactcattttcaggtacctaatgtagctgctagcatgcatgcacaacaatacaatttatatggtaaatggaaccaaataatggcttcactgaatgttatggctgcactgaagggaaatgtcacggtaaatagctgccaaattatggatcatgccgaagtgtcacaactgcactaaagacaaatagcactagaggctattgccactgtgacgcttttgagttatgaagaagggtagcggcctgatgcgaggctctttgtgtcctcattatagcaaagggttactggtgcaggggactaggaaaaacccgtccagtgtggtgcttagttattcatccatccctttcagacctaacagccacagccacacggaaagagactttgcctcacttttacattcacaaacaaacaaaggaggggggagcaggttttatgaatgtaactgtgcacaggaaatgactggtaatggaaaaaatgttgtaataaaataatctaatcaaagaatattattaaatttaacatagtctatgtccaaaaggcttagttgcttcttatgcagatagatgtgtgaaatctaagcagtaatgtactttctccctttgtaaagacttggggagtaaggacattaccaactaaattgcttcttcgaaactgaagtgagtcccggtttgtttcattttaatgggagggtaataaagatgaaagaccaacattttaactgatggatcccttaagctacagaatagaaatttattgtgttttgagggaatatactaaatgcagctatgtaaaaataaaattcaaacgcccaggattaaaataaaatataatctgaaaacctcatgttctctctttccccaaactaagaaagtgcactgcatgctgttttcacttattcttagaaaacaagcatgaaagattccgcccattcagataatgccaaaaatatgtttaaacttttttttattcttttgaaaaatgatttgtaaattgagggtcatagttcagcatcagtttcatcttctgggattattgttcaagaccagcctctaatgggaggtgaaacggtacgatggtctcaacacctttcttctgaactgtaatacatatcacaaaaagtacatccataattcagggcaattgtcagtctttttagagaaggggccagggtggaacaatcccagtgagtaaattatttctcagcgtggacttctctgcatgtcgggcttaaggtcaccagccgggcagggtggaaggagcttgcctctttgagaaaccaaggagtcccagtgatctgttaccatttggttatgacttctaaagagccaaatgctattccttcaagcctgttttgcaggcagaaaataccagcagtgtcatttaggggttcctttgatgatgactactgctgttaactgacctcagcattaaaaaaaaaaaaattcagggaatagtttgcaaagaaatgaaggaagttttgcatgatatattctataacttgtcattatatgatttcatctggatgaagttcctcaggagtaggatagagcctctgtaaatggtcattagtattacattctgtgtttatctaatgaaagtgcagtgacaagtagctgcttcttattaaaatgaaaatcctgcattatgtacttgaggaacattccagctaatgaggatgtaatgtcctcagtacaacgcagaccttctttttgtgttcaccaccacaagatgctggaagcttgacaaatgatatcatttaagacacatgcctgccttagggacctggtttttggcttcctgtttctggcttttatttgggtaacgtttataatggccacccgacttgtacctgggtaatgttttaaccccttccccagagttctcaattagcatgaatttactacagtcagagtttcctttaaattggggtgggggtgctaagcactgaaaatatctttcttgattactttaccatgtggacatatgggataaatactgtatttcagatttacataaaagtagattagtaatgcacagctttcagaataaaaactgataaaaaagaccaagcactatcaactttggacagtaatttcctaggtgttaaacaagttttctgaatacaatctggatgcaaaacggcctgatttgatgaattcataattttcttctgtatactttcattttattaaatattttattacttggttaaacacaagaattatctatgtaaacttcatgggcttttttgttgaaagttagatgttcagtaactaatttcccagttatggcccagaattaaacatttatgatcatatttcagaagtcaaaatacaaaactggattatcaaaacggttggtgtggtcactttaaactggactatcagtatggttgccgtggtcactttaagcgggattatcagtacggttggtgtggtcactttggtttatcatcaatacagttggtgtggtcactttaaactggattaccaatatggttggtgtggtcgctttaaagtttgttttcattttttttctatttttaattcttacgggtatatagaaggtgtatatatttatggggtacatgagatgtcttgaaacaggcatgcaatgtgaaataaataagcacatcatggagaatggggtgtctacctcctcaagcatttatccattgagttgcaaacaatccagctacactcagttatttaaaaatgtacagttattattgcttatagtcaccctgtttgctatcaaatagtaggtcttactctatttttttcattttaaactttgaattttatttttcctaggcttatagcatcatgctatcccccttgtaaaaggaggaatgcttggcatgagaaccttactgctgttaccatgaacaaactatggaatgttggcaaaagaaaaaaaaaagttacacaaaacacacaaataacattttaataatatgtatcagatcaagtgattcttagtagtagttgatattcacaggaagtcaaaaaaggacctatttcaattatgtctgcttgaatcctgtttaattgtttccctggctgagtagctagtgtgacacagcagcaagactaaaggggctctgtggtccacattgtcctcgagtctattcttgcccattatagacctgcccattggtgctcactcactgcatcccaggaggcttgactgtcctcaggaagcatgttggggtgcccttaagggtaagtatcccggggagcacagtttggagaaaaccaatacgtcttcatgtatgttgagaagcgctgggccaaagtacagactttttttttttttttttttttttttgggacaagacctcggctctgtcacccaggctggagtgcagtggtgcaatcatggttgattgcaacctcaacctccctggttcaagccatcctcccacctcagtctcctgagtagctgggactacaggtgcacatcaccatgcccggctaatttttttgtatttttttactagagatgaggttctactatgtagcccaggctgctctggaactcctgggctcaagcaatcctcccacctcggcctcccaaagtgctgggattgcaggcatgagccaccatactggcctaagtgcagaaatttgaacatgtgcctccaccccaagccaaaatttcccttgaggagcactatctatctgatgatgtctttgaaacggtatgaaattaaaataattaaaacatcctgcacataggtggtagcatctaatatgaaagatggatttatgcttagagctcagaaaaatcctcataaaattattgtgtcttatcctcggcacctaaagaactgaacagggtcttagaatgatcaaatggatggtttgtttggttggtgggagatgttgaaacgtgggtaaggaatggtgtccttagaagagaggttgccctagatgccgaaaccctggaggtccatggttgccagcagaaacttacagctgggaggagcctgcacccatctctggctcttgtgaatgagaagactcaatttgtgtttttgtttttttgagaaagggtcttgctctgtcacccagactgaagtacagtagcgtgatctcagttcactgcagccttgacctcctgggcccaagcgatcctcccacctcagcctcctgagtagttaagacttcaggtatgcattaccatgcctggctaatgtttttttattttttgtagagacaaggtctccctcgttgcccaggctggtctcaaactcttgggctcaagtgactttcctgcctcggccatccaaagtgctgggattacaggcataagccaccgcaacatgccccagttgcttttaaactgttaaatgtgggatttaaagaataatctagttctacccattttatgaatgaagaaaagaaactgggacccagagagaaaaggtgcccggtccaaggttacagagcccgttggactcagaagtgaagctggaacactggccaatgccctcccatccgccaggtgacttctctgcagtcccctttaccatctgcccgggtcctttgggatacggctgactaggggtttgaagaacagcaattggcctttgttatgaatctttttgtggagataaacccagtagaagtatcacggttctgaccatgaaagtgtgttcaactctaatccagcacaattaggattccagatcatttgattctgtgtcgtctaaatatcacagaaagttaaaaacaaattagcctcaatggaattaatggcttaatatccataatttagttttaatgctaggaggaagggctcctgtgaatgtgttcttacaaatcaaataaagaaaatcaaatagagaaaa

SEQ ID NO: 934 - DNA, 3528 bp, Homo sapiens
agcgtgcgccgctggccaggtgcgcaatagtggggtatgcgtcacggtctgcgccgcccgcggggccaggacggggcggagcttccgcctgggctggggttggcgagttcacccgcggcggagggtaactttgctgtgctgttttttgagcagttgtctggtccctggaagtgtagcatcgagagagttttctaattacgtttacaaaatatcttccctttggccatacaagtggtgactgccatgtcgaactcgcggcccaggtcccgccgagacgccgggggtggcgctggggcagccggccgggacgagctggtgtcgcggtccttgcagagcgcagagcactgtctgggcgtccaggacttcggcactgcctatgcccactacctcctcgtgctcagcctggcgccggagctgaaacacgacgtgaaggaaacttttcagtacacacttttcagatgggctgaagagcttgatgctctcagtcggatacaagacttacttggttgctatgagcaggccttggaactgtttcctgatgatgaagtgatttgcaatagtatgggggagcatctcttcagaatgggctttagggatgaagcagctgggtattttcataaagcagtgaagctaaaccctgatttcagtgatgcaaaggagaatttttatcgtgttgcaaactggttggtggaacgctggcactttatcatgcttaatgacaccaagaggaatacaatttataatgcagcaatccaaaaggcagtttgtttggggtccaaaagtgttttggacattggagcaggaactggaatactaagcatgtttgctaaaaaagctggagcacattccgtgtatgcctgtgagttatccaagaccatgtatgaacttgcctgtgatgtcgtggcagcaaacaagatggaagcagggatcaaactcttacatacgaagtcacttgacatagagattccaaaacatattcccgaaagagtgtccctagttgtaacagaaactgtcgatgcaggtttatttggagaaggaattgtggagagtttgattcatgcatgggagcatttacttttacagccaaagaccaaaggtgaaagtgctaattgtgaaaagtatgggaaagttataccagcaagtgctgttatatttgggatggcagtagaatgtgcagagataagaagacatcatagagtgggtattaaggacattgctggtatccatttgccaacaaatgtgaaatttcagagtccggcttattcttctgtagatactgaagaaacaattgaaccttatacaactgaaaagatgagtcgagttcctggaggatatttggctttgacagagtgctttgaaattatgacagtagatttcaacaaccttcaggaattaaaaagtcttgcaactaaaaagcctgataagattggtattcctgttattaaagaaggcatactagatgctattatggtttggtttgtgctccagcttgatgatgaacatagtttatccacaagtcctagtgaggaaacatgttgggaacaggctgtctaccccgtacaggaccttgcagactactggataaagcctggagaccatgtgatgatggaagtatcttgtcaagactgttacttaagaatccagagtattagtgtcttgggtttggaatgtgaaatggatgttgcaaaaagttttacccagaataaagacttgttatcgttaggaaatgaggctgaactttgtagtgccctcgctaaccttcagaccagtaaaccagatgctgtagagcagacatgtatattggaatctacagaaattgctttgcttaacaacatcccatatcatgaaggctttaaaatggcaatgagcaaagttttgtcttcactgactccagagaaactgtatcagaccatggatactcactgtcagaatgagatgagctctggaactggacagagtaatactgtacagaacatccttgaacctttctacgtgttagatgtgtccgaaggcttctctgttctgcctgttattgctggcacacttgggcaggttaaaccatacagttctgtggagaaagaccagcatcgtattgctctggacctcatatctgaagccaatcactttcctaaagaaacacttgagttttggctgagacatgtggaggatgaatctgctatgttacaaaggccaaaatcagacaagttatggagcataattatattggatgtcattgagccatctgggctcattcagcaggaaataatggaaaaagctgcaatatccaggtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctatacgtgtatttttggacctatcctcattgccctgtatacctttaagcaagccagtggaactcttaagactagatttaatgactccgtatttgaacacctctaacagagaagtaaaggtatacgtttgtaaatctggaagactgactgctattccattttggtatcatatgtaccttgatgaagagattaggttggatacttcaagtgaagcctcccactggaaacaagctgcagttgttttagataatcccatccaggttgaaatgggagaggaacttgtactcagcattcagcatcacaaaagcaatgtcagcatcacagtaaagcaatgaagagcagttttccaatgaaaactgtgtaaatagagcatcaacaagtacaaaattcttgtcttaattagtgggggtatataaaaattccttgtaatggtcaaatattttttaaaattgacattaataaagcatattttaaaagattctaaataaaagggtagcattattatagaaatactgctgcagatttgctttctggaaaaggatacatcactagttttttaaattaggaaacttcttttgctcgattttacagaatagggattttaaaagtcttatcgttattgacatgtgtaagtaaagcaaaactttacttttgtaggcatcttggccttttttcttaaatccaaacttgtaattgggaaacactgaaaggcttccactgaagactgagggttatggttacctgtaaattccaatcttgcttcctttaaatactcagtgtacatctgaaacatctcaggttttgttttgagaatgcaagcttgaaaaagaatttaagctataagctaaatgtaattaaaacagtaaaggagttagggaatacatcttcaggaggcagcatttttcttggtctactttggcaaaagaacatttaaaagctggtaacaaaacaaagttaaattgaaggaagacttaatcctatactatttttcaaagttttgatttggatgtacaataagtacattaattgatccaatttttacaaacttttgaaataaaggaagatcattattatgcctccta

SEQ ID NO: 935 - DNA, 2142 bp, Homo sapiens
gctttccttttagcttttgtaagttacacgtcaaaatggccgatctgacatcggtgctcacttctgttatgttttctccctctagtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagactatttgccggtttcacaagacataatttttatcaactagctcttaagagaggcatagcaaagtgggggttgctaccatttctagagagagaggacacagtcccggcctgggctgcccccgctccagtcaatgctcactgaaagtctgtcttagctgcctgtttgaatgactgttctttttctcatttttaattcttggactcatgtcctcattgcttcactcaattaaaaaaaaattattctccagtcccctcccactttgcttcttgtatgcattgtgaccgaccccacttcctcagaatgtaacggggccagagggaaacttctcacaaacttcgtagagcctcctcaggggaagctaggaagaagacatcaaatgtttttaagtcatgaccaaacaggcttgttggggacatatcatggggtgagctttgaagtgctggtggtccagaggggttgcagatacgtgacttggagcacccgtgtcttacgatggacagtgataaaggtgaacacacagagacagactattctctaagaatgtgagaaacctgatctggaagaggagctatataaacactatctgactatctttgtcttttggggccagtggctgttggcataatcacaagcctgtctgtcttcgagaagggacagtggagtcatccaggtgctgccacatgacaggcacggtgggcaccgatccacagtgggccccgccttccccagctcgcctccctgcctgtgctggcctggccttgcctgctggcaccattggagtaggagggggtggaacacagggggcccatcctgatcaggccccatctcaaggttggcactcctgcccatcacccttagaaggatcttttcccatggcttgacttccttcatttccctaactgaaatacacccactctcttggaataatgacgtaccactcagttggaccctcaagagtcactgctttgtctgtgctggtagtttgtgagaagtgacccgcacgcttccatttgatgcatttgatgtgagtgaatccatacatttgaatgtcattgtccttgagaccctacatgtgcagtttggctcatctcattaaagatgcttgatgtaataattggttagtttccttttattttcctgcaggcttttccatgagtattatttttttcaaagaacaaatctgtatggcttttccccatctccatattttgttttgctatgaattgctttgctttggtgaacttgtcctagtatgcttgcctcacaaacgttttagccattgtgaattttcttcatctctgtaaatagttcatctgtgcttctccctgatgacgttttattttttttcccctgtaagcaaccgaggtagaaaaataaattgtttaccatgg

SEQ ID NO: 936 - DNA, 668 bp, Homo sapiens
tgccccatgctgactccttgcttctttccagccggagccgctgccttgccccccggagactgaagacatggcacccaagagggccaagagaaggacagtagagggcggaagctccagcgtcttctccatgttcgaccagactcagatccaggagttcaaagaggccttcactgtgatcgaccagaaccgtgatggtattatagacaaggaggaccttcgggacaccttcgcagccatgggccgcctcaatgtgaagaatgaggagttggatgccatgatgaaggaagccagcggtcccatcaacttcaccgtcttcctgaccatgttcggggagaagctcaagggtgccgaccctgaggatgtgatcaccggagccttcaaggtcttggaccctgagggaaagggcaccatcaagaagaagttcctggaggagctgctgaccacgcagtgtgaccgcttctcccaggaggagatcaagaacatgtgggcggccttcccccccgacgtgggcggcaacgtcgactacaaaaacatctgctacgtcatcacgcacggcgacgccaaggaccaggagtaggggcacccgcgggcctccgctgcccgacgcttctgttcggcccgacctccaccccggctcccaataaaatttaactgatctttgtttctta

SEQ ID NO: 937 - DNA, 2121 bp, Homo sapiens
cttacggcggccggccttctttgtaggcctggcaccgtagaggtagaggagctacattggccgcgtcccctgtccctctgccctcttgcccatctgcccaaacttttgtatttgatctctgttttgatgtcgaaccccaaagcactgtaattggggggggcgggggggggggtggaacctgcggacctgagagcagcgcgcgtgcgcacgacacgcgctgtgcgccggaagagcacgcccagtccgggctgcgcggaggaagcgctggggtcccggagggcgggggtggcggcgccggaggtcgccatggctaccgagcccgaagccgcggagccggtggtgccttcgctcgtggatcgatacttcactcgctggtacaaaccggatgtcaaaggaaaattttgtgaggaccactgtatactacagcactctaaccgaatatgtgtcatcacattggcagaatctcatccagttcttcaaagtggaaaaacaattaaaagcatttcctatcagatcagtaccaactgtagcagacttcagaacaaggtctctgggaaatttaagcggggggcacagtttctaacagagcttgcacctctctgtaagatttactgctcagatggtgaagaatatactgtgtctagttgtgttagaggacgtttgatggaagtgaatgaaaacatcctccataagccatctattcttcaagaaaagccatctactgaaggctacattgcagttgtgttacccaaatttgaagaaagtaaaagcataacagaagggttactgacacaaaaacaatatgaagaagtcatggtgaaacgcattaatgccacaacagctacgtcatgaggattgacatggaacaaaaagcaaagtgggattcttgttacctggcctaaaccatcagggtactaaaggagaagaaccagtatatgtaaagcatacctaacagccagccatatgcaggggaggcctagtgcttcacttagttttccctctctgtcttcataatgagccttggttcccatttgtctacagcctgccagatctggcctgcccatgtactcacactgttctcttgcatctctctaacaactggcatgcaaggcatgtttttctgattaaaaacaaacaaagctctttgaagaagatttagaaaatacagaagagttttaagtagccaagtaaaaataatttacccatcatcccataatccagaagtaaatacatttgacccttgagcaacataggtttgaactgcaagggtccacttatgcatggactattttcaactataaacgagtcaaaaatatatcattaaccaaacacgaaacccacttatagagcaggttcatatactcaggttccaaagggccaactgcaggacttgagttctcacgtatggatttgggtatatgtggaagttcctggaaccaatcccctatgtaaaccaagggataactactacattttaacctacttctgtttgaacatatggtatggttattgcttttgcctcgttttcctaacagtttgaagtttaaaaaaacctaacccacctttcttacccagtcttctataatgtgcctaccaaaaagcctagtcctagcccatctgcctcaactcctctcccttttaggttgtagggaagaggccggagtgtagagtatattatatcttctgtcccccttatgccaacaagatggccttcccctctgaaacaaagtaaaactgcaacactgtgacttcttaaatgagggatatgtgaaaaggctatgaaaaatacaaaggctttcctaggaaatgtgttataatgcagcgggaagctaattcttgaaatatgcacattatagttactcagtctcacatactctagttactggcaaagaagttactgagaatatgtcattcaaaggcataggggcctttgaatggaacaaatgctttcacatcatttaaagtaaaaaaaaacctccaacaactgtgaatttatagtttaagagtgatttacactgaatttcaaataaaaggactataaaacgtgttatttttctgtaagggctataacatacatgtcaatatcactgtttttaaataaaatatacttttatacagaag

SEQ ID NO: 938 - DNA, 2382 bp, Homo sapiens
cccggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagaggtaagccagtctgggagcccctgcaacatgtgttcggttgtctggggcattgctgggggaagtaagagcttgaagatatactgttggcccaggaccaaggggtgaatcaataaaattagtttgtagcagaa

SEQ ID NO: 939 - DNA, 3986 bp, Homo sapiens
aaagaggctcgtggcgcccgccttccggtgcctcagtccctgccagtagccacccgacgccgtccggctgttcctcgttcgccctctccctccgcctagcccgcttctacccggacggctcccggcgcaggctgcagctgttccgtcagctgccgctcctcctcccagacgcagagcgccgctctgccccgccccccgcgcaggctgccgtccctacatccgggtaccgactccagccgcctagacgctggcactatggtcatggcggaggggacggcagtgctgaggcggaacaggccgggcaccaaggcgcaggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaataattttactgtgctacataaagtataacatacttggaaaggatttaccgttctgcaacaacggactggtacatacaggatgatcacaatggtaaggcacataaattattttcccactggaaacctgccctgtccaccccttctcatttcccttaaccttatcttcaaactactttagctgagaagcttttcaccagactgagttagtggtggcttatacctatttatatttgtattaattgcttacagattatacctcatattagcaattacattacactacaagaaaatgtatttgcataggctcttgcttatctttgttttgcaaaattgttctacttagaaaacagtccttaaaatagtttgactcttcctgttagtaatatattaatctttcatttaaccagctaggcagcattaaatagaattgaagaaataccatagtatttattttacaccccctctcccacgaagtttatgtttggattacatgcacgtgtgagattatttgcaataattcataggttccaagggtgttgatgaatagtcatacatttttttggactttgttataattcattgtggtaagaatgattgaaatgcagatttaacaatcttataatctattgaatgccatttttgataaagcactggaggtcttattgccaaactgattgtaatgaggcagtaagggtgaaaacattgtacatgttgtgaagaaagtatttaaatccaacttttgaacagatttaacaaacatgaggaacttttttatttagaaggataattttgaagatgaaaatgtattcatcttaattgttttttcaaatttaagggaataatttataccatcttttcagacaagaatgtacagcaaaaataaggggaacagtagtatactgagagtgtgtgtatgtatagtgtatgcctttccaagcttgccagtctttttggctttgaacactgcccatcagctacagtcattactgttccccaacccacaactatcttttaagaagtcttagttcacagtgaaaggaatgatgactttgaaattatggatttatattaatggcactataaaccaatggtaatggtaatttttaaacttgctaaatattgagaaactaaactactaagttaataaattatatatagcagtgtagctgttctctctagatggtgtctcacaatggatttctgttgcttgactattttcttagtgaatatttatactaaggtagtgactgagatttggtgatctggctgagtattttgaaacacattttgaataatatggcttagtgttaacggggacttaaatatgatttttttttcttactcatttcaccttccctgtactgtatgtttggaattgatcataaaacatctccaaaagaaaataatcagtttgtagtcttgcttttgtattcatgttgataatcttactaattgtgaagttgattcactactatactaggtaagacctaagtgaaacagttcctgtttttccttaatactgttttcagaattttgaaaatgtacttatatatacataaatactactaaaaaattaatgagcctggcaaaccattgatttataaaagtaagtgttctaagaggggaacaagacagttctgtgtgataaggaagttaggctccactttttgtttgaattaccctatgtatatccgaaggtaaacttaggcttttctttccaaaagatcgtatagtcaattcattctttttctcctatcacatctgggaaagtagctaacttttaactatttatgttcccataagtaacccttcttttgtgtgtatacatttccttttctctgacttgagatgtcaaatttggatttctagaacagtttctcagttaaattcttgatgacttaacaacttttactatcagaatacaattagaaatccttggtcaggcacaggggctcacgcctgtaatcccagcactttgggaagccaaggcagacagatcacctgaggtcaggagttcgagaccagcctgaccaacatggagaaaccctgtctctactaaaaatacaaaaattagccgggcgtggtgctactcgtgaggctgaggcaggagaatcgcttgaacccgggaggtggaggttgcggtgagctgagatcgtgccattgcactccagcctgggtaacgagcaaaactccgtctcaaaaactccgtctcaaaaaaaaaaaatccttgattacattgttagtaaggactgtgttacgattataaacacatttattggttgatgtcaaattcactgtaatagtagaactaagttttttatgtgagtactttgccctactgtctatatgatgacatcttttttgagcagctaaattttaaattgtatatactttattttgtgaatccttgttgaatgtgctaaaggtttctttgtgtagttcttccatgctatgcgaatattttagtaaaagtagttgattttta

SEQ ID NO: 940 - DNA, 2410 bp, Homo sapiens
gagacaggaaggtggcaaaggaaggagcccatttgcatgacaataattgagccaagaatagaaagccacagggatgcaagggtgaggctggcggctgagctgggctaaacctcacaaatcagactacccagctctgctccgcaggggaagggagactgagccctgggccaggcttggcagagagggaagcgggaggacacgaccccagggcattgtgggaacactggccaggctggactttgccttcctcctcgtcctttagccgggagcctgtctttgcttgcctttgcctttgaggctctgtggctgtggggctgagtggcatcatggcggctcagaaagatctctgggacgccattgtgattggggcggggatccagggctgcttcactgcataccacctggccaaacacaggaagaggatcctcctgctggagcagttctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctgggcaaagcccacctttgacctctggccagaagcctcccttctgtgcacaggagccagtttcacagatggagaagatgtctcagatgaagggagtgtccctgagatatcatccttttcttctgcctcgcctgaatcccccataaacaccagatgattgagtctaccttctttccttggcccgctccctttttcttctgcctcacttgaatcccccgtaaacaccagacgattgagtctaccttcttttcttggccacctccccattcacaactactttctcgctcccagaaggttgatcagatattctacaatcacagagtagcaaggacgtttgagatgggtatatcagtaagaagagggcacaagaactggctctggagaccaaagcagttgttaaaaattctctttgctgggggccgggtgtggtggctcacacctgtaatctcggcactttggggggctgagacaggcggatcacctgaggccaggaattcaagaccagcctggccaacatggtgaaaccctatctccactaaaaatacaaaattagctgggtgtggtggcgcatgcctgtaatcccagctacttgggagactgaggcaagagaatcacttgaacccgggaggtggaggtggcagtgagccgagattgcgccattgcactccagcctgggcaaaaagagtgagactctgtctcaaaaaaaaaacaaaacaaaaaaaacctctttgctggtatatttgaagagcttgggatggatttgactaaatctgccccgaggagggtgaacaaggtgatctcagagatcactactgctcttggagttccttctcctaaagctaaggccagcctccatcacaaatgcccataaaatctggctcgtctttgatgaacaataaatatttgttgaacaaataaataactgccctgca

SEQ ID NO: 941 - DNA, 618 bp, Homo sapiens
ggacaactcggtggtggccactgcgcagaccagacttcgctcgttctcgcatgcctcgctccgcttttcctccgcaaccatgtctgacaaacccgatatggctgagattgagaaattcgataagtcgaaactgaagaagacagagatgcaagagaaaaatccactgccttccaaagaaacgattgaacaggagaagcaagcaagcgaatcgtaatgaggcgtgcaccgccaatatgcattgtacattccacaagtattgccttcttattttacttcttttagctgtttaactttgtaagatgcaaagaggttggatcaagtttaaatgactatgctgcccctttcacatcaaagaactactgacaacgaaggctgcgcctgcctctcccatctgtctatctggctggcagggaaggaaagaacttgcttgttggtgaaggaagaagtggggtgggacgacagtgaaatctagagtaaaaccaggctggcccaaggtgtcctgcaggctgtaatgcagtttaatcagagtgccatttttttttttgttcaaatgattttaattattggaatgcacagtttttttaatatgcaaataaaaagtttaaaaacttaaaaaaa

SEQ ID NO: 942 - DNA, 7474 bp, Homo sapiens
ggggacggtgggagcagatccatttccgggttggcaaaaggggcggtggcggcggcggcggcggcggcggcggcggcgacggcgagaaagagcttgccggggggcgagcaggacaggacgaagccggagtgtaggcggcagaggattcgctcccagagcagctgcggccaggtatatgaatgacctaaaggtacaaataaagacggagagagaacagtgccaactgggagcagggcaagaatgccaattcctcctcccccgccacccccacctggtcctcctccacctcccacatttcatcaggcaaacacagagcagcccaagctgagtagagatgagcagcggggtcgaggcgccctcttacaggacatttgcaaagggaccaagctgaagaaggtgaccaacattaatgatcggagtgctcccatcctcgagaagccgaaaggaagcagtggtggctatggctctggaggagctgccctgcagcccaagggaggtctcttccaaggaggagtgctgaagcttcgacctgtgggagccaaggatggttcagagaacctagctggtaagccagccctgcaaatccccagttctcgagctgctgccccaaggcctccagtatctgccgccagcgggcgtcctcaggatgatacagacagcagccgggcctcactcccagaactgccccggatgcagagaccctctttaccggacctctctcggcctaataccaccagcagtacgggcatgaagcacagctcctctgcccctcccccaccacccccagggcggcgtgccaacgcaccccccacacctctgcctatgcacagcagcaaagcccccgcctacaacagagagaaacccttgccaccgacgcctggacaaaggcttcaccctggtcgagagggacctcctgctccacccccagtcaaaccacctccttcccctgtgaatatcagaacaggaccaagtggccagtctctggctcctcctcctccgccttaccgccagcctcctggggtccccaatggaccctctagccccactaatgagtcagcccctgagctgccacagagacacaattctttgcataggaagacaccagggcctgtcagaggcctagcacctcctccacccacctcggcctccccatctttactgagtaataggccacctcccccagcccgagaccctcccagtcggggagcagctcctccacccccaccacctgtgatccgaaatggtgccagggatgctccccctcccccaccaccataccgaatgcatgggtcagaacccccgagccgaggaaagcccccacctccaccctcaaggacgccagctgggccaccccctcctcctccaccgcccctgaggaatggccacagagattctatcaccactgtccggtctttcttggatgattttgagtcaaagtattccttccatccagtagaagactttcctgctccagaagaatataaacactttcagaggatatatcccagcaaaacaaaccgagctgcccgtggagccccacctctgccacccattctcaggtgaagcctggcttggtcccgttcctcaggaaaaggatggaccttctcttcttctcagatggtcccttccattcccctgaaacctgcatgagagctcctaacatgtttctccaatgcaatcaagccctagactccaaatgtcctcccagctcacctccatctatgcatctcatctctggatttggtgatcagactctatattgacagtaggatctcaaaccctgcatccatccttcctccagcaagccctgctagccacatgaggaacaagtttccgtgtcttctgccttcctcttggggaaaggtgccttgttgtgatgaattaactcactgttagggcagggtggagaatggtactccttccttctcctgtccactgtgggggaagcttggcaggtatattatatttcatcatttaggaggctggcatgaccaggacttatgggtgggaggggagcatttttagtgaagcaagaaaggagtttgccaagaagtgatctgttttaaaggtcatatttggagaaagggcaaggaattgggtctgctttatttttgggggtattttgtttttgttctcacctgctgcccccccaccccaccaccccagggataaattggatataaacactaaatactaatcagttgaacttaacatttaataaaaagaaagggtgaaataaactgaagaccattttagaactagtcagttctctgcagcaaagggaacaggagccatttgaaccctctgggacccctcaccccactgcttcagggtgctaggctgagggatgtttttcctcccccttaccgcccatgcccttgaaagaaaagtcactttttgtggagggcatcattcattcctgattcacaaaccccaaaaacctctggtgggagataggaagatagggcgtgggcctgggccttaacctcaatcttgtgtctgcctcagtcttttctgactggccctgaagttgtcagtggctctttctgtccttcagcccctggaaggtgctccaggataacaaagaagggcaggttgaagcccctcatggaaggagctggctttgtggggctgcaaaggacttttaagtcctgcctgtactgaagttcacagcccacctgactgagcagactcttcctgttcctttctctaccacccttgccttcccaggactgcacggtttaacacagcagagtacagaagggtgaagaagtgagcagaggcttatgaagatattcagatactcttctatgccaggaagcacaaagactttgttgagatttgcctcagttcagtagatcttccttggcagccagccataggttgtttctttgtcttccgggtcctaaagagcacagagaaaatggaggtccccagtctaggtaggaagctgattggatgaggacttctttttttccgacagcaggatggggctcttgggctccacacaccagatgctttggttttctacaactgttgctatgtgtagagggtgctcagagcgtggcatgagagcaaggagaccatggctactctttgaaatggatggggaaaattagcttaaaaatttaatcacgagattgcgccactgcactccagcctgggcgacagagccagactccgtctcaaaaaaaaaaaaaaaaaaaaaatttaatcacacacatcacaggcttaaactgtcttagagacctttccagttgattggatcacaggctagggatctgtgcatggtgccaggtgaaacccaagtctccccagtgctaggtgagggagggctcaacgggggtaatgtgtatggggtctgctgtcctttgccatcccctggaccatattaactctgggacagaccatgattaggtctgtcaccaaacttttcctaatcattttttatgtatcattcttctttctaatctgttagcagttatctcccagaagtatccctagcatcctgaagcaaacagaactgccgggcgctgtggcttatgcctgtaatctcagcaatttgggaggccgaggcgggcggatcacctgaggtcagaagttcgagaccagcctgtccaacatggtgaaaccccgtctccactaaaaacacaaaaattatctgggcgtggtggcatgtgcctgtagtcccagctactggggaggctgaggcaggagaatcgcttgaatccaggaggtggaggttgcagtgagtggagatggcgccactgcgctccagcccgggtgacagagtgaaactccatctcagaaaacaaacaaaccaaacaactgagagagggcatgctagtggagggaaaaggagagagtacaagagttgatactgcatcagagttccagggcagatactgacaagtgactgaactttgactgtgaagtcttcccatttatttttgaaatgggagtcgatgccttttgtacgttatcaaagtgtttttttttttttcctcctttactcagacatagagcatcaaaatatcacgagtaaagccaaaccccagcttttcactggggctgatatcttcctccccatggcccactgccccctcatattccccagcacttggactgtgtcacatgggtattgattgtatacttgttgtcttggcctcatgcaaaaaggcctgggtctagatctagtcagatgagttttttttagagcatgttgatgatacaacacctgtttaaatgtctgccttatatgttatttggtcccactgttaataatagatttattactatgtatatttactattgaagatgggaatgtgatctgcatagttatcagtctattttgtatgttgtaaaaagcttctaatttaggtttaaggtgggctggctacaagagcactaaaactcctcaccttttaaactgctctttttatctgcttgtgggaatgtcgtctctttcgtggaagattgggtggtctcatgttgaggctgttgcccagtcccattaactcccttgtccccccacagaaggaagagacattgcccagctaagcatcaggaagctgtgttaaaagcccttctatgggtttggttttgtgatgtttttccctaatgggaaaaacgttatagttgtttcttactgccctgtctgggaagcagggcaaacctccaggtttttaaatgagctagatgcccctcttcctcttctctggtcactgaacctggaccaaagcactttgatattccaggtgtgattttctctgtcatggggatttgctccactgcagagccccatcattttcacagcgtaggccaacagagtgagaacctagggctaccctagctgatggatgtgaggctgctgtctacaggagctcatcccagccctgttaactggcagtggcaaggatactcgtcatcggccattgcactggggaactccctcaccccatggcttcccaacttgaaacccagatttacctccagggagaggtgagaaaaaaattgtaaatagacttgctaaagagcaactcagggttggggtgtgttttaattctcctgatcacttgaaataatctgtaggctgagtgcttatgggggtgggggagaagggtgactccagggtccttccattttgtgaagctctgggggtggagtgtgggcatctgaggccctatgatggcactacattgagctgtctgcccttccggaaacccaacctgcaatcaactgcaaatcaaattcttcacattccagctacagtctttctttccccattgaatctcagtccctggccatgtggtcaaggtggctttctgttaagctaccctaatttcgggaatgggaggggagagaggagggccattacaactctgccttcaagactcatctcttaaaaacaaaacgaaacaaaactacaaccaccatcaaaaccacacgcaaaaaaaaaaaaaaaaaaaaaaaggataactttaaccgaaggaagggtttggttccattcaactccacattcattgtgcctttacttgcattagatttctgtgctttcttcctttccctctttgaagcaattaaaatcttccttgataactgctgtttctttctactcttgtttctggcaatttagtgggttccttctctagtggtcttaaatctcattccactggtggcaagatggggcctagccttcttttcacatgtctaatcttttcctttctcatggtgccctccatggaagtcacagtcaacactgaataaatgactagaatgacacgtgtgcgtgcgcacgcgtgtgcgtgtgtgtgttcatctgtctgcatgtggatcaatttcttttagaaaataatttattgtatgatttattttggagttatattctgattacagtgctccctctcccaaatagcattgattttttcccccctctaaaatgtataatctggtctcaggttggattctttggtacatttctctcttctggatgccatgcagcttaattaaaaccttgcttaaaaacaaaaagtgaaaattgtgtactcttgtctggaataccgcctcaggtggtggcacagagaggggagaaaacctttgcctcataatttgggtaagtgtagtggtttgattccaggtcccttgaaaaagtagatctactgaattgggcagactcatctatagctttctgagggtcttctctcctcctctccagctgtattttgaaaattacagttctagttggctgggcgcgatggctcatgtctgtaatcccagcactttgggaggccaaggcgggtggatcatttgaggtcaggagttcaagaccagcttggccaacatggtgaaaccccgtctctactgaaaatacaaaaattaaccggtgtcatggcgcatgcctgtagtcccagctactcgggaggccgaggcaggaaaatcacttgaacccaggaggcggaggttgcactgagctgagatcatgccactgcactaaaaaaaaaaaaaaaaaaaaaaaaaaaaaaaaaaaaaaattctagagttctagttacccttcctgggagattctgatggtccttattttattattattattatttttttttgagacaggatgttgctgtcatccaggctggagtgcagtggtgtgatcatagctcaccgcagcctccaactctcaagctcaagtgatcctcccacctcagcctcccgtgtagctgggaccacaggtgtgtaccactatgcctggctaattttgaaaatttttttgtaaagacagggtctccctatgttgcccagactggtctcaaattcctgggcttaagtgattgtcccacctcagcttctcaaagtgctgggattacaggcatgagccaccgcacccagccagtccttattttatatttccacctaactcccctttgcccacgatttcagggaacctaggaggcttcctggccttgtgaccttttccttgaatctcttataattctttctacctgtgttgcatggcagattctcagattgaggctaaagaaaagaagggtggggacaaagcatacagaatgtgtgtatctgtttttatgtgggtgttggctgtttttcgtcactgctttttaagctgaatcttagctggttttcttgaactttgactttaggtgtaaaaattcaaccagacattctctccttactgtggtcagctgacatcataaccactaaggcttaatgagcttaacttgcactttcatcactagcaaaggtcttgaagttatttctcttactgattcataatgggtgtgtgtatgaatcactctcacataatttagatataaaaacctatgaggatgagggagggaggggaagaaaaaaaaggactcctttcattttcatccgtacttcccagatgggctgaatctccgattatttgacccatcattgttattaatatggttaataaactacctatttattgattgaa

SEQ ID NO: 943 - DNA, 5503 bp, Homo sapiens
atgaattacccgggccgcgggtccccacggagccccgagcataacggccgaggcggcggcggcggcgcctgggagctgggctcagacgcgaggccagcgttcggcggcggcgtctgctgcttcgagcacctgcccggcggggacccggacgacggcgacgtgcccctggccctgctgcgcggggaacccgggctgcatttggcgccgggcaccgacgaccacaaccaccacctcgcgctggacccctgcctcagtgacgagaactatgacttcagctccgccgagtcgggctcctcgctgcgctactacagcgagggtgagagcggcggcggcggcagctccttgtcgctgcacccgccgcagcagcctccgctggtcccgacgaactcggggggcggcggcgcgacaggagggtcccccggggaaaggaaacgtacccggcttggcggcccggcggcccggcaccgctatgaggtagtgacggagctgggcccggaggaggtacgctggttctacaaggaggacaagaagacctggaagcccttcatcggctacgactcgctccgcatcgagctcgccttccggaccctgctgcagaccacgggtgcccggccccagggcggggaccgggacggcgaccatgtgtgctcccccacgggcccagcctccagttccggagaagatgacgatgaggaccgcgcctgcggcttctgccagagtacgacggggcacgagccggagatggtggagcttgtgaacatcgagcctgtgtgcgtgcggggcggcctctacgaggtggatgtgacccaaggagagtgctacccggtgtactggaaccaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatgctgttcatagtttcaagttgagtcgaaaccatgtggactggcacagtgtggatgaagtatatctttatagtgatgcaacaacatctaaaattgcaagaacagttacccaaaaactgggattttctaaagcatcaagtagtggtaccagacttcatagaggttatgtagaagaagccacattagaagacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataactaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcatatttcagacttcaagaatcgttctttaatctcccacaacttctttttccggaaaatgtaatgcagaataaagataatgccctcgtggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactctcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcatacaacactagttcaattttttaaataaactttttattatgttacatgtacttcagagaaagctaaagtttctctaaacttgacacggagtactccataatgggtacatttcattagctttattagaaaactagtaaatgcttttgaataggtagtatgacagctattttaaatgtataaacatttgtgtgccaaacaacatatatgaagggatgtgatgccactaactagtgcacattgtttctcaatgtgccattgagacacaaggcacagtaagtcaggattctgaggcattggaagggttttcttcagctgtaattgtttccacagtgcttttcatctgaggggctcaaagtttaagagtgcattcaataacccatgtactagcttcttgaggtaagtaaataaatcttgttctcatgttacatgttaatacaccaaggcaccaaaacatttaaagtgccatgaattagattacatcagaaatcagaaaagcttggattgagctagtcaccgtggttcacgcctgtaatcccaacacttcgggaggccaagatgggaggatctcttgagcccaggatttcaagaccagcttgggcaacatagtgagaccctcttctctgcaaaaactgacaaaaattagccacttgtagtggtgtacacctgtagtcccagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccaggccatattcttttatatgctgttcaatgacttgattcacatgtgaccttttagtagtttgcaaacaataataacagaagttgcaattcataattcagagaaatgaccatgaagccggtgtttccctgcttgatttctatgttcttggattctcacacaaaagaggagttacctagaggggatcagtagccatccctgttgcacacaaccctcacttctgagtggtttccactaggttccacttaaggtgctgtcttttcttaacttgcaaggaattgcttagcttcccaataatcattgtcaaactgggagcaaagttggtcagctgtatctctcacctcctcctttcttcataagatagtagaatctgtggcttacttgtaggttttacttagtgcttcagtactgttggctgttttggccttttgctgaatttgcacaacaacataaagcacttctttttaatgtttaaaaaaaattccaaggctccatgaccaagtatgtgactcactaagaaacccttgctataaaaggcttttgatgaaatcttagcaaagctaaattatctctaacttagagattcctatgaactcaggtcattttcatagcctgtttattttgtaggtctaatttagttctcaggaaaattaaactcatgctatatgactgtatcgttaaaggtacttgagcgtatgttgctgtaggtggtatgacactcaaatgcataagaacttgaagggatttattcttaaccactagaatatgaagagccctttttacctgagaagagtgaaattatgtcagaccttttaatttgatatcactgagtaaaaggtatgttcctatagccataggaatatgtctgcttcctttttttcatgttgagaaaacagtcaaatttaaccatttggagtttatttgaattcttggaaagagcaatattcaaaaccttttcaaaaataagatattctggactactggatggatgttttgttttcagttcatttttcatcagtagagatggtgatttcggttttgtagtatccttgtttctatgtctgtgcatgttaacattggatgtatttgtatatacttaattaatatacagactgtgtgtcattctggcttgattagaagctaagtcagttactgagtaacattttgcaactttattccagcaagtactaaatcggccaaaaaaagttttgtttttgataccattaaaattttattctct

SEQ ID NO: 944 - DNA, 1510 bp, Homo sapiens
gaggaagtagacaaacctaaatatgtgtctgaactccaaggaatatgaacaagatgcctgctggtgaacaagaatgtgaatataacaaagaagggaagtactactctaaaggagttaaactggtgagaaaaaagaaaaaaattcctggttaccgttggggggacattaagataaacatcataggtgaaaaggatgatttaccaattcatttctgtgacaaatgtgatttgcctattaaaatctatgggcgaataattccgtgcaagcatgctttttgctatcactgtgctaatttatatgacaaagtcggatataaagtatgtccgcgctgtcgttatcctgtgctgagaattgaggcgcataaacgaggttctgtcttcatgtgtagtattgttcagcagtgcaagagaacatacttgtctcagaaaagcttacaggctcatatcaaacgccgccataagagagctcgaaaacaagttaccagcgcttcgcttgaaaaagttcgtcctcatattgctccgccacaaactgaaatctctgacatccctaaaagactgcaagacagggaccatctaagctatattccaccagaacagcacaccatggtgtcactaccgtctgtgcaacatatgctacaagagcaacataatcagccacataaggatatccaggctcctcccccagaactatctctaagtctgccttttcccatccagtgggaaaccgttagtatttttacgagaaaacatggcaatttaacagttgatcatattcagaataactcagattctggtgctaagaagccaacacctcccgactattatcctgagtgtcaaagtcaaccagcggtatcgtcccctcatcatattatacctcagaaacagcattatgcgccacctccatctccatcatcaccagtaaaccatcaaatgccatatcctcctcaggatgtagttactcctaactcggttcgtagccaagtgccagctctaaccacgacctacgatccatcatctggatatattattgtaaaggtgccacctgatatgaattctcctccactacgtgctccccagtctcaaaatggtaatccatctgcaagtgaatttgcttctcaccattataaccttaacattttacctcagttcaccgaaaatcaagaaaccttgagccctcagtttacacaaacagatgcaatggatcatagaaggtggcctgcatggaaacgactgtcaccttgtccaccaacgcggagtccacctccttcaaccctacatggtcgatcacatcattcacaccagagaagacatagacggtattaaggatgataacagtatttggaactgaagacctgatgggaaaaaaaccttcaagttctatactgtactgtggataagcggctcagttcagcagagctggagttgaacaactttgttcctctggtgtggtaaattgacctaaaggtgacctctgacgatttcctgaaataaatatgcaatgttacattttc

SEQ ID NO: 945 - DNA, 3568 bp, Homo sapiens
atagttttcaggttaagaaagccagaatctttgttcagccacactgactgaacagacttttagtggggttacctggctaacagcagcagcggcaacggcagcagcagcagcagcagcagcagcagcagcagcagggctcctgggataactcaggcatagttcaacactatgggtcctcctctgaagctcttcaaaaaccagaaataccaggaactgaagcaggaatgcatcaaagacagcagacttttctgtgatccaacatttctgcctgagaatgattctcttttctacaaccgactgcttcctggaaaggtggtgtggaaacgtccccaggacatctgtgatgacccccatctgattgtgggcaacattagcaaccaccagctgacccaagggagactggggcacaagccaatggtttctgcattttcctgtttggctgttcaggagtctcattggacaaagacaattcccaaccataaggaacaggaatgggaccctcaaaaaacagaaaaatacgctgggatatttcactttcgtttctggcattttggagaatggactgaagtggtgattgatgacttgttgcccaccattaacggagatctggtcttctctttctccacttccatgaatgagttttggaatgctctgctggaaaaagcttatgcaaagctgctaggctgttatgaggccctggatggtttgaccatcactgatattattgtggacttcacgggcacattggctgaaactgttgacatgcagaaaggaagatacactgagcttgttgaggagaagtacaagctattcggagaactgtacaaaacatttaccaaaggtggtctgatctgctgttccattgagtctcccaatcaggaggagcaagaagttgaaactgattggggtctgctgaagggccatacctataccatgactgatattcgcaaaattcgtcttggagagagacttgtggaagtcttcagtgctgagaaggtgtatatggttcgcctgagaaaccccttgggaagacaggaatggagtggcccctggagtgaaatttctgaagagtggcagcaactgactgcatcagatcgcaagaacctggggcttgttatgtctgatgatggagagttttggatgagcttggaggacttttgccgcaactttcacaaactgaatgtctgccgcaatgtgaacaaccctatttttggccgaaaggagctggaatcggtgttgggatgctggactgtggatgatgatcccctgatgaaccgctcaggaggctgctataacaaccgtgataccttcctgcagaatccccagtacatcttcactgtgcctgaggatgggcacaaggtcattatgtcactgcagcagaaggacctgcgcacttaccgccgaatgggaagacctgacaattacatcattggctttgagctcttcaaggtggagatgaaccgcaaattccgcctccaccacctctacatccaggagcgtgctgggacttccacctatattgacacccgcacagtgtttctgagcaagtacctgaagaagggcaactatgtgcttgtcccaaccatgttccagcatggtcgcaccagcgagtttctcctgagaatcttctctgaagtgcctgtccagctcagggaactgactctggacatgcccaaaatgtcctgctggaacctggctcgtggctacccgaaagtagttactcagatcactgttcacagtgctgaggacctggagaagaagtatgccaatgaaactgtaaacccatatttggtcatcaaatgtggaaaggaggaagtccgttctcctgtccagaagaatacagttcatgccatttttgacacccaggccattttctacagaaggaccactgacattcctattatagtacaggtctggaacagccgaaaattctgtgatcagttcttggggcaggttactctggatgctgaccccagcgactgccgtgatctgaagtctctgtacctgcgtaagaagggtggtccaactgccaaagtcaagcaaggccacatcagcttcaaggttatttccagcgatgatctcactgagctctaaatctgcaatcccagagaatcctgacaaagcgtgccacccttttattttccgtcaggtgccaggtcttagttaagattcacaatctttagaaagaatgagattcacaataattaactcttcctctcttctgataaattccccatacctcccaatccaagtagcatctgtagctacataacctatatacctccagcagctggacatggggaggcgacagtcctatctagacatcatacacatttgccaagaaaggatctctggggcttccgggggtgagattcaagtaggacaataacaagaggctggacaccctacagatgtctttgatgttttcagttgtttgatatatctcccctgtagggcatgttgaggaaggaggagggctgatcaaggccaagctggtctagcctgacatcctagctcctgactgaacactatagacttcccagcagcatttcacccagcagccagagccggctttaagtccccaacccttacagacaccactgccaccaccaccaaccacgaccaccaccaccaccaccactcaccaccatcatcacctccggaaagtgtagtcctgccctaacccaagtcacccccgacagtaaattttaccttcatgttgagaaagcttcctggtgcttaatcaagagctggagttcaatgagtcctagacagtgagaggggcctgagcttcagctcaatggaagcctgctgtgtgccacaagacggaaaagtggaagaagctgcagtgggagacaaagcctcggtcccccacccatccacacacacctacactcacacacgcgcacatgggcgcgcacgaactaccattcaggcagtcagtgggcaagaggaaagataagtaagtaccatacacacctaaaagatgagagaattcatccagacatattacagccagtttggggcccctgactgcaatgtgaaacctctcgctgctgctaggtttacaaacaagcccattgtcctgtgcctcctaatatcatttgtactgaagaccccatctggggacttgagactttggtcccagcccagactcctcagacttttctctcagttgggatgcttcactcgctgggggtgtttgtttgccctctcatttttcagtacttctacagaattttctctagagtcagtcattatgaaatgtacttccctccatcttaacctatcaactttctgcccctccttcaaggcccagtataaatgccacctcctccatgaagccttccctaattccaccccaaacccccaccttcaacaatatttcaacgcttctgcaatgatgaaaaagaaacatagttgtagtacttagcctacctagaccagcaagcattcatttttagctcgctcattttttaccatgttttccagtctgtttaacttctgcagtgccttcactacactgccttacataaaccaaatcacaataaagttcatattcagtaca

SEQ ID NO: 946 - DNA, 3286 bp, Homo sapiens
gaacgccggggcggcccgaagatggcggcggtggctggatctggggctgccgcggctccgagctcactgctcctcgtggtgggcagcgagttcgggagcccggggctcctcacctacgtcctggaggagctcgaaagaggcatccggtcttgggatgtcgatcctggcgtctgcaaccttgatgaacagctcaaggtctttgtgtcccgacactctgccaccttctccagcattgtgaaaggccagcggagcctgcaccaccgtggagacaacctggagaccctggtcctcctgaacccatcagacaagtccctgtatgatgagctccggaaccttctgttggaccctgcctctcacaagctactggtgttggctgggccctgcctggaggagacgggggagctgctgctacagacagggggcttctcgcctcaccacttcctccaggtcctgaaggacagagagatccgggacatcctggccaccacgcccccacctgtgcagccgcccatactcaccatcacctgccccaccttcggtgactgggctcagctggcacccgctgtgcctggccttcagggggcgctccggctccagctgcggctgaaccccccggcgcagctgcccaactctgagggcctgtgcgaattcctggagtacgtggctgagtctctggagccaccgtcccccttcgagctgctggagcccccgacctccgggggcttcctcaggctgggccggccctgctgctacatcttccctggaggcctcggggatgccgccttcttcgccgtcaatggcttcactgtgctggtcaacggtggctcaaaccccaagtccagtttctggaagctggtgcggcacctggaccgcgtggatgccgtgctggtgacccaccctggcgccgacagcctccccggcctcaacagcctgctgcggcgcaaactggcggagcgctccgaggtggctgctggtgggggctcctgggacgacaggctgcgcaggctcatctcccccaacctgggggtcgtgttcttcaacgcctgcgaggccgcgtcgcggctggcgcgcggcgaggatgaggcggagctggcgctgagcctcctggcgcagctgggcatcacgcctctgccactcagccgcggccccgtgccagccaaacccaccgtgctcttcgagaagatgggcgtgggccggctggacatgtatgtgctgcacccgccctccgccggcgccgagcgcacgctggcctctgtgtgcgccctgctggtgtggcaccccgccggccccggcgagaaggtggtgcgcgtgctgttccccggttgcaccccgcccgcctgcctcctggacggcctggtccgcctgcagcacttgaggttcctgcgagagcccgtggtgacgccccaggacctggaggggccggggcgagccgagagcaaagagagcgtgggctcccgggacagctcgaagagagagggcctcctggccacccaccctagacctggccaggagcgccctggggtggcccgcaaggagccagcacgggctgaggccccacgcaagactgagaaagaagccaagaccccccgggagttgaagaaagaccccaaaccgagtgtctcccggacccagccgcgggaggtgcgccgggcagcctcttctgtgcccaacctcaagaagacgaatgcccaggcggcacccaagccccgcaaagcgcccagcacgtcccactctggcttcccgccggtggcaaatggaccccgcagcccgcccagcctccgatgtggagaagccagcccccccagtgcagcctgcggctctccggcctcccagctggtggccacgcccagcctggagctggggccgatcccagccggggaggagaaggcactggagctgcctttggccgccagctcaatcccaaggccacgcacaccctcccctgagtcccaccggagccccgcagagggcagcgagcggctgtcgctgagcccactgcggggcggggaggccgggccagacgcctcacccacagtgaccacacccacggtgaccacgccctcactacccgcagaggtgggctccccgcactcgaccgaggtggacgagtccctgtcggtgtcctttgagcaggtgctgccgccatccgcccccaccagtgaggctgggctgagcctcccgctgcgtggcccccgggcgcggcgctcggcttccccacacgatgtggacctgtgcctggtgtcaccctgtgaatttgagcatcgcaaggcggtgccaatggcaccggcacctgcgtcccccggcagctcgaatgacagcagtgcccggtcacaggaacgggcaggtgggctgggggccgaggagacgccacccacatcggtcagcgagtccctgcccaccctgtctgactcggatcccgtgcccctggcccccggtgcggcagactcagacgaagacacagagggctttggagtccctcgccacgaccctttgcctgaccccctcaaggtccccccaccactgcctgacccatccagcatctgcatggtggaccccgagatgctgccccccaagacagcacggcaaacggagaacgtcagccgcacccggaagcccctggcccgccccaactcacgcgctgccgcccccaaagccactccagtggctgctgccaaaaccaaggggcttgctggtggggaccgtgccagccgaccactcagtgcccggagtgagcccagtgagaagggaggccgggcacccctgtccagaaagtcctcaacccccaagactgccactcgaggcccgtcggggtcagccagcagccggcccggggtgtcagccaccccacccaagtccccggtctacctggacctggcctacctgcccagcgggagcagcgcccacctggtggatgaggagttcttccagcgcgtgcgcgcgctctgctacgtcatcagtggccaggaccagcgcaaggaggaaggcatgcgggccgtcctggacgcgctactggccagcaagcagcattgggaccgtgacctgcaggtgaccctgatccccactttcgactcggtggccatgcatacgtggtacgcagagacgcacgcccggcaccaggcgctgggcatcacggtgttgggcagcaacagcatggtgtccatgcaggatgacgccttcccggcctgcaaggtggagttctagccccatcgccgacacgccccccactcagcccagcccgcctgtccctagattcagccacatcagaaataaactgtgactacacttg

SEQ ID NO: 947 - DNA, 6400 bp, Homo sapiens
aggggcggaggtgacagcgggctggggactggcggctgcaactgcctgccgcgccgagggaccgccgggcggcggaaagcaggttataaaacatggaggctggctcagtggttcgagccatttttgacttctgccctagcgtatcagaagaactgccgctctttgtgggagatattattgaggtgctggcagtggtggatgaattttggcttctaggaaagaaggaggatgttacaggacaattccccagcagttttgtggaaattgtgaccattcccagtctaaaagagggagagaggctgtttgtgtgcatttgtgaattcacatcccaagagttggataatcttcccctccatcgaggtgacctggtgattctcgatggcattcccactgcaggctggctgcagggccgaagctgctggggcgcacggggcttcttcccatcttcatgtgtccgcgagctctgcctctcctcacagagccggcagtggcactcccagagcgccctgtttcagattccggaatattccatgggacaagcccgggccctaatggggctttctgctcagctggatgaagagctggacttcagggaaggggatgtgatcaccattattggagttcctgaaccaggctggtttgaaggggagttagagggccgaagaggcatttttccagaaggttttgtagagctgttggggcccctgaggactgtggatgagtcagtaagttctggaaatcaagatgactgcattgttaatggtgaagtagatacccctgtaggagaagaagagatagggccggatgaggatgaggaggagccagggacctatggggtcgccctgtacagattccaagccctggagccaaatgagctggatttcgaggtcggggataaaatccgaattctggcgaccttggaagatggctggctggaaggatccctgaagggcaggacaggcatctttccttaccggtttgtgaaattatgtcctgacacacgggtggaggaaaccatggctctgccccaggaaggcagccttgccaggatcccggaaacttctttggattgtttggagaacaccttaggagtagaggaacaaagacatgaaaccagtgaccatgaggccgaggagcctgactgcattatttctgaagcacccacttctcccctcggtcatctgacttcagagtatgacacagacagaaactcttatcaggacgaggacaccgcaggagggcccccgagaagcccaggcgtggagtgggaaatgcctcttgccacagactctcccacatctgaccctacagaagtagtcaatggtatttcctcccaacctcaggtcccttttcatcccaacttgcagaaaagccagtattattctacagtgggagggagccacccgcactcagaacagtaccccgaccttcttcccctagaagcaaggactagagactatgccagcctacctcccaaaagaatgtattcccagctaaaaactcttcagaagccagtgctccctctttacaggggctcttctgtttcagcttcaagggtagtcaaacccagacaatcaagtcctcagctccacaacctagcaagttatactaaaaagcaccacacgtccagtgtttactccatctcagagagattggagatgaagcctggtccgcaagcccaagggcttgttatggaagcagcaacacattcacagggagacggcagcactgacctggactcgaagctgacacaacagctgatcgagtttgagaagagcttggcagggcccggcacagagccagataaaattttacgccacttttcaatcatggactttaactctgagaaggatattgtccgaggttcctcaaagttaatcaccgagcaggagctgccggaaaggagaaaggccctaaggccaccgccacctcgtccctgtactccggtatccacttctccccatttgctggttgaccagaacctaaaacctgcaccacccttggtggtgcgaccctctcgcccagctcccctgcctccctcagcacagcagagaacgaatgcggtatcccccaagctcctatctcgacaccgtcctacctgtgagaccttagaaaaggagggccctggtcatatgggaaggagtctggaccagacctccccatgccccttagtgctggtgaggattgaggaaatggagcgggacttggatatgtacagtagagctcaagaagagctaaacctcatgctggaggagaagcaggatgaatcatcaagagcagagaccctcgaggatctcaagttctgtgaaagtaacattgaaagtttgaatatggaactccagcaactaagagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccagcacatccgggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttcctccaagtgcacatttagccttaaaatcctgggagtcgggagacaccgtggagtcctaacatccacagtgtctgctggtcgtggtcagaaggcagtaatgcaagagtccttttgtgaagagtgtttctatgtagagatgtttatatttaagtagttcttttataaataaaagcatttctaatggc

SEQ ID NO: 948 - DNA, 3801 bp, Homo sapiens
ttcagcaaaaggtctttcctcccttgctctctcctccaaccactggctcagcctctccgcccgctgcctgtgaatgatgcaatggaaggtgtgctggggtcgccctgtgtcccgtgcataggagcatctcagcctccaggtcctctcctttggggctcacggcacccccatgctacgaaccgcaggcagggacggcctctgtcgcctgtccacctacttggaagaactcgaggctgtggaactgaagaagttcaagttatacctggggaccgcgacagagctgggagaaggcaagatcccctggggaagcatggagaaggccggtcccctggaaatggcccagctgctcatcacccacttcgggccagaggaggcctggaggttggctctcagcacctttgagcggataaacaggaaggacctgtgggagagaggacagagagaggacctggtgagggataccccacctggtggcccgtcctcacttgggaaccagtcaacatgccttctggaagtctctcttgtcactccaagaaaagatccccaggaaacctacagggactatgtccgcaggaaattccggctcatggaagaccgcaatgcgcgcctaggggaatgtgtcaacctcagccaccggtacacccggctcctgctggtgaaggagcactcaaaccccatgcaggtccagcagcagcttctggacacaggccggggacacgcgaggaccgtgggacaccaggctagccccatcaagatagagaccctctttgagccagacgaggagcgccccgagccaccgcgcaccgtggtcatgcaaggcgcggcagggataggcaagtccatgctggcacacaaggtgatgctggactgggcggacgggaagctcttccaaggcagatttgattatctcttctacatcaactgcagggagatgaaccagagtgccacggaatgcagcatgcaagacctcatcttcagctgctggcctgagcccagcgcgcctctccaggagctcatccgagttcccgagcgcctccttttcatcatcgacggcttcgatgagctcaagccttctttccacgatcctcagggaccctggtgcctctgctgggaggagaaacggcccacggagctgcttcttaacagcttaattcggaagaagctgctccctgagctatctttgctcatcaccacacggcccacggctttggagaagctccaccgtctgctggagcaccccaggcatgtggagatcctgggcttctctgaggcagaaaggaaggaatacttctacaagtatttccacaatgcagagcaggcgggccaagtcttcaattacgtgagggacaacgagcctctcttcaccatgtgcttcgtccccctggtgtgctgggtggtgtgtacctgcctccagcagcagctggagggtggggggctgttgagacagacgtccaggaccaccactgcagtgtacatgctctacctgctgagtctgatgcaacccaagccgggggccccgcgcctccagcccccacccaaccagagagggttgtgctccttggcggcagatgggctctggaatcagaaaatcctatttgaggagcaggacctccggaagcacggcctagacggggaagacgtctctgccttcctcaacatgaacatcttccagaaggacatcaactgtgagaggtactacagcttcatccacttgagtttccaggaattctttgcagctatgtactatatcctggacgagggggagggcggggcaggcccagaccaggacgtgaccaggctgttgaccgagtacgcgttttctgaaaggagcttcctggcactcaccagccgcttcctgtttggactcctgaacgaggagaccaggagccacctggagaagagtctctgctggaaggtctcgccgcacatcaagatggacctgttgcagtggatccaaagcaaagctcagagcgacggctccaccctgcagcagggctccttggagttcttcagctgcttgtacgagatccaggaggaggagtttatccagcaggccctgagccacttccaggtgatcgtggtcagcaacattgcctccaagatggagcacatggtctcctcgttctgtctgaagcgctgcaggagcgcccaggtgctgcacttgtatggcgccacctacagcgcggacggggaagaccgcgcgaggtgctccgcaggagcgcacacgctgttggtgcagctaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgaggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccagtgcaggctgcagatgattcagttgaggaagtgtcagctggagtccggggcttgtcaggagatggcttctgtgctcggcaccaacccacatctggttgagttggacctgacaggaaatgcactggaggatttgggcctgaggttactatgccagggactgaggcacccagtctgcagactacggactttgtggctgaagatctgccgcctcactgctgctgcctgtgacgagctggcctcaactctcagtgtgaaccagagcctgagagagctggacctgagcctgaatgagctgggggacctcggggtgctgctgctgtgtgagggcctcaggcatcccacgtgcaagctccagaccctgcggttgggcatctgccggctgggctctgccgcctgtgagggtctttctgtggtgctccaggccaaccacaacctccgggagctggacttgagtttcaacgacctgggagactggggcctgtggttgctggctgaggggctgcaacatcccgcctgcagactccagaaactgtggctggatagctgtggcctcacagccaaggcttgtgagaatctttacttcaccctggggatcaaccagaccttgaccgacctttacctgaccaacaacgccctaggggacacaggtgtccgactgctttgcaagcggctgagccatcctggctgcaaactccgagtcctctggttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccaggcatggtggcgggcacctgtagtcccagctactcaggaggctgaggcaggagaatcgcttgaacccgggaggtggaggttgcagtgagccgagatcgcgccactgcactccagcctgggcgacagagtgggactccatctc

SEQ ID NO: 949 - DNA, 4116 bp, Homo sapiens
ctggtctgcggctgagatacacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgtaaggattgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctc

SEQ ID NO: 950 - DNA, 1622 bp, Homo sapiens
gaggcccgaggggcggcccaggactcgaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccgaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacgg

SEQ ID NO: 951 - DNA, 2917 bp, Homo sapiens
ggcggcggggctgggcggtgcttccgcctgcgcgaggccgcgccgggccgcttggaggcgcccggtgcagtcgggaacccgcgctaggtttcgccggccgcgcggccagatgaggggggcgatggagctggagcctgagctgctgttgcaggaggcccgcgagaacgtggaggcagcgcagagctaccggcgggagctgggtcaccggcttgaggggctgcgtgaggcgcggaggcagatcaaagaaagtgcatcacagacaagggatgttctcaaacagcattttaatgatttaaagggaacccttggaaagctcctggatgagcgattggtgacccttttgcaagaggtggacaccattgaacaggagaccattaaaccactagatgactgccagaagctcatagaacacggagtcaacactgcagaggacttagtccgagaaggtgaaatcgccatgcttggtggtgtgggagaagagaatgagaaactgtggagctttaccaaaaaggcctcgcacattcagttggacagcttaccagaagtacctttactggttgatgtgccttgtttatctgctcagttggatgactcaattcttaacatagtgaaagaccacatttttaagcatggaacagtagcatctcgcccaccagtacagatagaagaactaatagagaaacctggaggcatcattgtacgatggtgtaaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgtgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgagtaactataagttcaaataatagagaagtggtttttgactggttacttgatcagtcttgtggttctctttactttggatgctcatttttctatcctggatggaaagtgttagtgttttagatgtttgggtgcttggctttggttttcagggtctaacgtagctgtcctcagcccagcgtagttgtaattgctttaaaaaaaaagttgaattcatctctaacttaggccattggaaagtgtttactggattcattttgtaatattttagcaaaaagagacttcaatgttgtggacaaaatcatacaattcagtcaattttatttttagcatactgttaaatatcacatcacaataaaaatcaaattggcattaaaagtatagaagatataggaagttctatacccttccactgtacttctcaaagttggttattagaccaggaaaacttaatgtaatattatttttaaaatcatcttaaaggatccaagtccatgtaactctttagaacaagaggaataggtcagatagaagaagctgtgtaatgtattaatacatccgttcatgtgctgtccacatgaatgtgttgactgtgctctccatgttcaggtatttgtaagcagtgttgacttttatcccctcttcagtaatctttaagtccccaaaacattataactttttctttttttgttgagacggagtctcactcttgtcactcaggctggagtgcagtggtgtgatctcagttcactgcaacctctgcctcccacgttcaagcgatcctcctgcctcaggctcctgagtagctgggattacaggcgtcggccaccacacctggctaatttttgtatttttagtagagacagggtttcaccatgttggccaggctggtcttgaactcctgacctcaggtgttccacccacctcagccttccaaagtgctaggattacaggtgtgagccactgcagtggaccaatttttgtatttttttaaatgcttgaccaagtgtctaaaataggcaagtagtaccttttgttctttcattgcaatttgatacagtataggctacagtatttttacagggtaaaactagttatggcagtagtatgcacagcagtgttagccatttcatatgtatgtaatatgcacgtgtgtatccaatctgcctgtgacatgcattttactctttgcagagaatgagctgcagtccagtttaatgtcagtttaataagtggtctctttttagcagagcaaaaaaatatagcgtaaatacttattttttttaaaaacttacttaaatttgtgtgtaaaatatttatttgaaggactttaatatgtaaaaataattgtcttctatgccaccctacagattttattttaatgtgaattatttttttcatttcatttttaccagtatagtaaaaaagtagaaaagcaagtatgatatttttgtaagataatttatttggggattcatgttccctgttagacaatcatgaccttttctacttgtctttttatatataagtagtagatttccacttgtttagggattaagaagatgttctagaatgtagataccttgtccagccataggaatc

SEQ ID NO: 952 - DNA, 2804 bp, Homo sapiens
gaaatggggcggggagagagtgacaccacccctctgcctgtggctggattggtgggcgtggcgggggcgtggcgatgcctgccctccggacaaggcggggttggtggccagggcgaccgcggggcgggccagcgccgggggtcgtggccgggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggccgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggcattttcctgtcttctctttagtatgatccctcaaaacctcactaactggaaggatgattttgtctcagtttgtactcctaaataaaaagtaaacatgacacctctaaaagaa

SEQ ID NO: 953 - DNA, 6330 bp, Homo sapiens
atggctgaggtcaccgtcccaagggtgtatgtcgtgtttggcatccattgcatcatggcgaaggcatcttcagatgtgcaggtttcaggctttcatcggaaaatccagcacgttaaaaatgaactttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactggacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaagttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctcaatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagcagtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggggctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaagtgagcctacccggtcatctctgttcacccacctcacattccagctttaactccagttttacatccctttattgccattaactcgttaacttatgttgtctaataaaggcaaattctatt

SEQ ID NO: 954 - DNA, 4946 bp, Homo sapiens
gtaaaaatttttattaaagtaccagtaaaactaaaagtgcctacttttagttttcactgtattttcttcaactcaggccctccctctgttgttacctgccatctgacacggaattttgtgtaattttccttccaagtaaagaagggaagtttagccccagcctctaactggttcccaaagtttttgtctctgaagccgcagtcacttcctggagcgtctctggctgggtgttgcagtgctggctgggagggtggggcaacaatttacaattctgaacacgtgctttctgggcaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggccgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggcattttcctgtcttctctttagtatgatccctcaaaacctcactaactggaaggatgattttgtctcagtttgtactcctaaataaaaagtaaacatgacacctctaaaagaatcgctccatctcagttgctcgtcgcgtgcacaccatgcttattgagtggtgtctggttggtggtgtcagctcagggcaggggacagcaggcaggacccggaaaacagaacccaggtcttcccaggcgagcactccctccctcgtccacacaagtggaggctcactcgtggccccctgcatgttccgagaagtgtccctgtctctgctccttaacggctgtggggccacaggaagtccagctggcttaaacaaagaattgattggcccacttgacataaaagaacagagtaaactcaatgaaaggaaaaggctccttgaagtggttggttccagggctgggcagggaagatgcaagatgagtctggaccctctcacatcggaacgtaaggatgcgctcctgagggcgtggggctgcgtccaaggacacaggagccagcctggaagagtttgcaggggcccaggggagcaattggagtgagaaaatagcagtagtgttggatttttaccatggaataaacaacaatccatgagtccatactaatataaataaagtgacaaagtgggtgagaaggaccagtgcccctggatgaagaatctctgctcatgtgggaggaaggtgggagatcaaagctggagcacttgctgctgcaggtgagacccctgacacactctcaaattggtaggcaaaggtttaaagaacgggatatttgcttagcttaaaagcacctcccaaggggaaaacagtaacttcacagtggagagacctggcaggcaccaccctcagatcaaaatgaacctcagcagtaatgacacgtccacatcagcacccccaacaccactccctgaggaggacatgccagttctgggaacatcacactcatcgtgacaaaacatcagacaaacccaaacggatgaaatgtgaggaaaatctgtagttggttttacgtggatgttaatctcttagttttgatcattgtgctgtagctgcataagaggttagctgggtgaagtgtatctggggaccctctatggcttttgcatcttttctctaagtctcctgtcatttcaaagtaaaaacaaaaaaagaagacaagggtagcggcttcaggtacagctggacccagcactcagtgctatctgggcttgtggctccaactcaactcctccatcagaactgtgagaaatgcattctttcagcttctaatcctgcaaaaagaactgcatggtcttcccccagaaatcctaagagtagctgctggtgtctcatgcatgcgagctgcatatgggcccccgttagtcaggaacccatgctgagaggtgctatgctttgaatgtttggctcctcccaaactcgtgttgaaacttaatagccattgtaacagtattaagaggcagggccttcaagagctggtcaggccatgagggccctgtcctcctgactgagtgaatgctgttattgtaggagtgggcttgtttggcctcctcttgctctctctacccctctctgagcccttgtgttgtgggatgacacagccagaaggcccttgccaggttccggtccctccaccttggacctcccagcctcccgaacgttgagccaatacatctctgctcattgtaaattacctagtcttgggcattgtgttacagcagcaaaaagcagcctacggcagtcaccgtgctaacacctgcagcagcctgcggcggtcaccgtgctaacacgtgcagcagcctgtgtggctcaggccagtcagcttcccctggaagcaagtgtgaggtcgtcgcctctggaagtgctagcggagggtgatctcccggaggaaatcagagtggtgttctactagaaggccgatgactcctgggtaaagtgccaatgctcacctccatctctgcaagctcagtccctcgtggaatttccaggagcacaagggcaatctcgacagctccacgttcccagtgcccgacccaagcctggcccatgatcagataaatgcctaagtggggtggcatggacatttgcacacgtccagactgctttatgttagaagctgagctggcatgccactagctggttttgatgtaaacaacaattttgtaaaaccctggactgaatgggtctgactaacggctggttctgtgaacttgagcctcagcgtcctgtgtcagaagagcacaaaccactttcccagagaggttatgaagacagaaatgaccctgtgacccctttgcaaagtatgaagaacggttcccactcatgcatggagctggatcttctcaagtgggaaacaggcgtggtaaataaatactgttgtttcagctggtgt

SEQ ID NO: 955 - DNA, 6525 bp, Homo sapiens
ccgagccgggagccgagcgcgctgggcgcggccgtcccgctgccgccgccaagcccggagtgcgccagcggccatggttcccgcggcggcgccgggcgcctgagccccgggacgcaagcgctggaggcgggctgccggctgtgcgggcgctccggagagaccgacagaaggtgagcactgtgggctatgggatggatgaggtggagcaggaccagcatgaggcccgactcaaggagctgtttgacagttttgacacgacgggcacagggtccctggggcaggaggaactcaccgacctttgccacatgttgagcttggaggaggtggccccagtgctgcagcagacattacttcaggacaacctcttgggcagggtacattttgaccaatttaaagaagcattaatactcatcttgtccagaactctgtcaaatgaagaacactttcaagaaccagactgctcactagaagctcagcccaaatatgttagaggtgggaagcgttacggacgaaggtccttgcccgagttccaagagtccgtggaggagtttcctgaagtgacggtgattgagccactggatgaagaagcgcggccttcacacatcccagccggtgactgcagtgagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactggacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaagttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagggaaaaaatggaaacagagtgtaatagaagaacctctcaaatagaagcccagtttcagtctgattgtcagaaagtcactgagaggtgtgaaagcgctctgcaaagcctggaggggcgctaccgccaagagctgaaggacctccaggaacagcagcgtgaggagaaatcccagtgggaatttgagaaggacgagctcacccaggagtgtgcggaagcccaggagctgctgaaagagactcttaagagagagaaaacaacttctctggtcctgacccaggagagagagatgctggagaaaacatacaaagaacatttgaacagcatggtcgtcgagagacagcagctactccaagacctggaagacctaagaaatgtatctgaaacccagcaaagcctgctgtctgaccagatacttgagctgaagagcagtcacaaaagggaactgagggagcgtgaggaggtcctgtgccaggcaggggcttcggagcagctggccagccagcggctggaaagactagaaatggaacatgaccaggaaaggcaggaaatgatgtccaagcttctagccatggagaacattcacaaagcgacctgtgagacagcagatcgagaaagagccgagatgagcacagaaatctccagacttcagagtaaaataaaggaaatgcagcaggcaacatctcctctctcaatgcttcagagtggttgccaggtgataggagaggaggaggtggaaggagatggagccctgtccctgcttcagcaaggggagcagctgttggaagaaaatggggacgtcctcttaagcctgcagagagctcatgaacaggcagtgaaggaaaatgtgaaaatggctactgaaatttctagattgcaacagaggctacaaaagttagagccagggttagtaatgtcttcttgtttggatgagccagctactgagttttttggaaatactgcggaacaaacagagcagtttttacagcaaaaccgaacgaagcaagtagaaggtgtgaccaggcggcatgtcctaagtgacctggaagatgatgaggtccgggacctgggaagtacagggacgagctctgttcagagacaggaagtcaaaatagaggagtctgaagcttcagtagagggtttttctgagcttgaaaacagtgaagagaccaggactgaatcctgggagctgaagaatcagattagtcagcttcaggaacagctaatgatgttatgtgcggactgtgatcgagcttctgaaaagaaacaggacctactttttgatgtttctgtgctaaaaaagaaactgaagatgcttgagagaatccctgaggcttctcccaaatataagctgttgtatgaagatgtgagccgagaaaatgactgccttcaggaagagctgagaatgatggagacacgctacgatgaggcactagaaaataacaaagaactcactgcagaggttttcaggttgcaggatgagctgaagaaaatggaggaagtcactgaaacattcctcagcctggaaaagagttacgatgaggtcaaaatagaaaatgaggggctgaatgttctggttttgagacttcaaggcaagattgagaagcttcaggaaagcgtggtccagcggtgtgactgctgcttatgggaagccagtttagagaacctggaaatcgaacctgatggaaatatactccagctcaatcagacactggaagagtgtgtgcccagggttaggagtgtacatcatgtcatagaggaatgtaagcaagaaaaccagtaccttgaggggaacacacagctcttggaaaaagtaaaagcacatgaaattgcctggttacatggaacaattcagacacatcaagaaaggccaagagtacagaatcaagttatactggaggaaaacactactctcctaggctttcaagacaaacattttcagcatcaggccaccatagcagagttagaactggagaaaacaaagttacaggagctgactaggaagttgaaggagagagtcactattttagttaagcaaaaagatgtactttctcacggagaaaaggaggaagagctgaaggcaatgatgcatgacttgcagatcacgtgcagtgagatgcagcaaaaagttgaacttctgagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagaactcagtggttggaagtagcagagaagggtgcagttctctgcctgagatagtgtgtgaagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaagtgagcctacccggtcatctctgttcacccacctcacattccagctttaactccagttttacatccctttattgccattaa

SEQ ID NO: 956 - DNA, 3013 bp, Homo sapiens
cggggcggccgccgccggtgggccgcagatgaagaggaggcggtggcagtggtggaagaagaggcggcggcggcgggggtagggagcctggaaacgcgagcggggatggtaggtggtttggacccgccgggccgccgtcgtttccagaaagggtttgactggaggaacctctggagcagctgttggctggctcctctggctgatggcatgttgaggtacatgggccagcggcagcgagggcatccaatccagaggggtccactctagaggccaggccaccagcaccatgggccagtgtgtcaccaagtgtaagaatccctcatcgaccctgggcagcaaaaatggagaccgtgagcccagcaacaagtcacatagcaggaggggtgcaggccaccgtgaggagcaggtaccaccctgtggcaagccaggtggagatatcctcgtcaacgggaccaagaaggccgaggctgccactgaggcctgccagctgccaacgtcctcgggagatgctgggagggagtccaagtccaatgccgaggagtcttccttgcaaagattggaagaactgttcaggcgctacaaggatgagcgggaagatgcaattttggaggaaggcatggagcgcttttgcaatgacctgtgtgttgaccccacagaatttcgagtgctgctcttggcttggaagttccaggctgcaaccatgtgcaaattcaccaggaaggagttttttgatggctgcaaagcaataagtgcagacagcattgacggaatctgtgcacggttccctagcctcttaacagaagccaaacaagaggataaattcaaggatctctaccggtttacatttcagtttggcctggactctgaagaagggcagcggtcactgcatcgggaaatagccattgccctgtggaaactagtctttacccagaacaatcctccggtattggaccaatggctaaacttcctaacagagaacccctcggggatcaagggcatctcccgggacacttggaacatgttccttaacttcactcaggtgattggccctgacctcagcaactacagtgaagatgaggcctggccaagtctctttgacacctttgtggagtgggaaatggagcgaaggaaaagagaaggggaagggagaggtgcactcagctcagggcctgagggcttgtgtcccgaggagcagacttagtggctctgtcccaggagcagcagcaaggatctgccagctgccctgcagccaactgaggaattggaccattttggaaattactgaagatccggatattttctactttacacctttctctgccttgtatctgaaagggctctaaaatgctgtatcatgttttaggcactttcttcatttttttggttattttggttatttcctttttggggggatctcccagaatatttgaacctggttacatgttgtgtatctttttttgaagccttcagatagaataagcctgccatttcttgcacaaatttaggttttttttttgtttttttttgtttttttttttttttttttggtaggggagggcatagagcagggcggggggatgggactgttaggttgaattaacattacaaaatgatacagtgccagatctcagtttcgcatattgtttttcagggcaggtctgtactgtgtgtagtgctgtttacatagatgaatttaggttgtaataattatttttaaagatttacacagatttgaatagcagtgttaactgttaaccacattgcattaattcccaggcgatttagagctcttggagagccaaggccagccaagagcatttgtagtctggtgacaacccccttttaagctaatttatccagaaccctgatttccctcacttcttgctcattccttctttgacctattgcatttcatgttgagtttttccatcaacatgctgcacctgtcagtcaagtgagcattttttaagaacacattgtactgagaaccacttaagcattgaatgcggagaaagcagtgctacctcagttttgctggaagtagacttctttgatagttttctttctttgatgaagtttctgtattttcatgttgtaagtggaaatacttttttttgtttgtttgtttcatttgccttggagccaaagtttctgttcctggtggtcgggaaactgcctgccggccaactgacttgaaggaaaactgtggtatggagctctgcttgaatttttttttttttaatatttttatttttttctttgaatatcatcagcttacttgtctggcaagggcagaagcctggggttggcctgaactctgccaaacaaatatcaaagtgtatttaatagttaaatttgtgccctttcccttcttgctgcacccatgttgtcacttaacccccaggagttatttattatctttttgttaaagtcaggctcatttggggtaatgtgatgactgtttaggtttacatgaccctcctctcctttccctacccccaaatatgtatatatacatatataaaatatgtatatattttacctatataaaatatatatatatacacatatatgtatctatattcctttgtttctttgcctgcttatactggccataaaagagggagctgccttcaatgtataaagtataagaagagtgccagggaatgccataatggaggcttttggatctgaatttggaccatttcactaaagagaacatgagtttgctcagccctttcctcacaagagggagggccccggttccccagacttctccacgcgctggctccataaaggccagctttggccaggctgccacaggggcctgaggagctcactctgggcctacctggtttcagttagagggtcctcctgttatttttccatttaaaaagtatgtcctcagaaaactgtactggaaggatgggtggcaggaacttgtatagttcagcttccaacactttggaacagattaaaaagggaatcttttaaataaaaacgtataaaaata

SEQ ID NO: 957 - DNA, 2531 bp, Homo sapiens
aagttcgtcaggaaccagaccctgagattggtggatccatgccgtacgccactgtgcagcccgcggattggcaggaaaagccactccccatccctcctgttcgggagctgtggcagacgctctggttgttaaggcgactcgtcccgccttctggggcactagtttgactttgtgattggctactagtatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatgcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcggccatgttacaggagctgaattttggtgcatatttgggtcttccagctttcctgctgccccttaatcaggaagataacaccaacctggccagagttttgaccaaccacatccacactggccatcactcttccatgttctggatgcgggtacccttggtggcaccagaggacctgagagatgatataattgagaatgcaccaactacacacacagaggagtacagtggggaggagaaaacgtggatgtggtggcacaacttccggactttgtgtgactatagtaagaggattgcagtggctcttgaaattggggctgacctcccatctaatcatgtcattgatcgctggcttggggagcccatcaaagcagccattctccccactagcattttcctgaccaataagaagggatttcctgttctttctaagatgcaccagaggctcatcttccggctcctcaagttggaggtgcagttcatcatcacaggcaccaaccaccactcagagaaggagttctgctcctacctccaatacctggaatacttaagccagaaccgtcctccacctaatgcctatgaactctttgccaagggctatgaagactatctgcagtccccgcttcagccactgatggacaatctggaatctcagacatatgaagtgtttgaaaaggaccccatcaaatactctcagtaccagcaggccatctataaatgtctgctagaccgagtaccagaagaggagaaggataccaatgtccaggtactgatggtgctgggagcaggacggggacccctggtgaacgcttccctgcgggcagccaagcaggccgaccggcggataaagctgtatgctgtggagaaaaacccaaatgccgtggtgacgctagagaactggcagtttgaagaatggggaagccaagtgaccgtagtctcatcagacatgagggaatgggtggctccagagaaagcagacatcattgtcagtgagcttctgggctcatttgctgacaatgaattgtcgcctgagtgcctggatggagcccagcacttcctaaaagatgatggtgtgagcatccccggggagtacacttcctttctggctcccatctcttcctccaagctgtacaatgaggtccgagcctgtagggagaaggaccgtgaccctgaggcccagtttgagatgccttatgtggtacggctgcacaacttccaccagctctctgcaccccagccctgtttcaccttcagccatcccaacagagatcctatgattgacaacaaccgctattgcaccttggaatttcctgtggaggtgaacacagtactacatggctttgccggctactttgagactgtgctttatcaggacatcactctgagtatccgtccagagactcactctcctgggatgttctcatggtttcccatcctcttccctattaagcagcccataacggtacgtgaaggccaaaccatctgtgtgcgtttctggcgatgcagcaattccaagaaggtgtggtatgagtgggctgtgacagcaccagtctgttctgctattcataaccccacaggccgctcatataccattggcctctagccctgcgtgccaagtgtccagagccttggaagcagcttcaggttctgctcctgtagtacagaaggtgcagtacatctatgggctgtgattccccttgcccatcagagaggagcatttcaatctgctttcctgccttacatcaaggtgggcaagggattataattaattgcagggctcaagccaccaatctatgaagacctcaggccagggggtgaggaattagtgctggatttgaagctacgcactcagcctcaagaactccctggaatatccctgagaacatggggtttgaacggattttcagcctttttctgttcttgttttgatggttttgtgtaagaggaaatacaaataaagttatagccctttactgcacgaccatgctgccccctg

SEQ ID NO: 958 - DNA, 1067 bp, Homo sapiens
gtctcatggctcctgggagcgtcaccagcgacatctcaccctcctcgacttccacagcaggatcatccaggtctcctgaatctgaaaagccaggcccgagccacggcggtgtcccaccaggaggcccgagccacagcagcctcccggtgggacgccgccaccccccggtgctacgcatggtgctggaggcgctgcaggctggggagcagcgccggggcacgtcggtggcagctatcaagctctacatcctgcacaagtacccaacagtggacgtcctccgcttcaagtacctgctgaagcaggcgctggccactggcatgcgccgtggcctcctcgccaggcccctcaactccaaagccaggggggccactggcagcttcaaattagttcccaagcacaagaagaaaatccagcccaggaagatggcccccgcgacggctcccaggagagcgggtgaggccaaggggaagggccccaagaaaccaagtgaggccaaggaggaccctcccaacgtgggcaaggtgaaaaaggcagccaagaggccagcaaaggtgcagaagcctcctcccaagccaggcgcagccacagagaaggctcgcaagcaaggcggcgcggccaaggacaccagggcacagtcgggagaggctaggaaggtgccccccaagccagacaaggccatgcgggcaccttccagtgctggtgggctcagcaggaaggcaaaggccaaaggcagcaggagcagccaaggagatgctgaggcctacaggaaaaccaaagctgagagtaagagttcaaaacccacggccagcaaggtcaagaatggtgctgcttccccgaccaaaaagaaggtggtggccaaggccaaggcccctaaagctgggcaggggccaaacaccaaggctgctgctcctgctaagggcagtgggtccaaggtggtacctgcacatttgtccaggaagacagaggcccccaagggccctagaaaggctgggctgcccatcaaggcctcatcatccaaagtgtccagccagagggctgaagcttagggccagaggcaggggcggaga

SEQ ID NO: 959 - DNA, 2769 bp, Homo sapiens
gcgacgccgagtttcactctggctgccttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaaggatctggtactgttctggagtggcctgtagcagacactgaaccaccagccagctgcatttgttgtcctggaagtcattgccaactctgccagtcacactggggtccccagagaagtcaagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaaggagcgaccccgaagccagagccagagccagagcaggtcataaaaaactacacggaagagctgaaagtgcccccagatgaggactgcatcatctgcatggagaagctgtccacagcgtctggatacagcgatgtgactgacagcaaggcaatcgggtccctagctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagccaaa

SEQ ID NO: 960 - DNA, 4686 bp, Homo sapiens
gagagagggaggacccgtcacaggtaacgatgcgcccagtgagcgtcctttcctctggggccaaccagcgtctccgcgccgctgccgccaacctcgcgccgaactacgccctgagatttgggcgggtagcgattgggggaaaacaggcaacctaagagttattaccgttagcagcgaagactgcgactaacgtcaacgacggagactgcgtctgccttcgcttccgcctcgtagccccgggaaccggaaatccgtctgccccgggtcacgtgcttaggagccatattgtcgctagtggccgctggggctgggaggggtgtgctagagaggcgcagcttctctgggcgtggtttttatcctgggggaaggatcggtggaatgtgaggggaggtggaggagatggcggcgacggcccgggaagatggcgccagcggtcaagagcgaggtcagcggggctgcgagcactatgacagaggatgtctcctaaaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaacgtgttatgaagaaatgttgaaagaaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaaactgttttatagaaagttttttccaaagttttctatgtttggctcaattagggcagtatcatcagttctataatgtaaaagaaattttctttcttttgaggtattccataaaagtagttgggaaaattattatgtaaaataataagactcttccaaagccttaataaaaacatcaacattgaaaacagttttttttaggttgcccaaaattatttcttcaaagagtcattcattccttcatttagcaagtatttattgagcaactgctatgtggcagatatgtttctagatgctgtagagacaacagtgaacaataaagataaaagtccttgtcctcacagcagtacattctattgttcatcatatttgatcaatgtactcatttttctttatgcaaggagtggatgtcttattgtaaatgaatagaatatttcttccctaagcgtgtgaaaataggggatggatgagtgggaagggcatgggatattcctggcaagatctctgatttcataatacttttttgggctcatgtagtggaattaaatatacctcttacttcaggaacaaagttaacaaatatgtttgatgatccagccgactttgacactgttatctccgtaatagctttaccattaggctaggatgtaaaatgtacatttatcagttgataagtacctattgagcaccagttgtatttccaactttgagctatttgaatcttctttgaataaggaagttagccttttaactagaaagcctaagagttctggcacatttatttcttcttttgttgaaatttattcacctagataaaggcagcagtttgggactcagatctttattttatcccaccttcttgtcttctgtattccactcttcttatgttctttcccttcatctgtttccttggcctggccagagcagcagtgctgatcttcatttgggaaaggatgttcctgggtattaccaattagtatacagataagtaaagactagttttccagatctaatacttttttttgaagtggttttgctctgtcatttaggctagagtgtagtgaagtgatcgtagctcactgcagccttgacttcctgggctgaactgatccttccacctcagcctcctgagtagctgggactacaggtgtgtgccaccatgcccagctaatttttaattgttttgtagaaacaaagtccaggctggtcttgaactcctgggctcaagcatttctcctacctcggccttccaagggctaggattacaggcatgagccactgtgcttggtccagatgtattactttttatgtttggtattattctgccaaaccaatcatgttattgtttttaatcattgaatcattggatctttaaataggagtgagtatataataataaggctcttctgttttcaacatctgtgctgggtcatgcattagcattaattactacaatgattctgtggggtaagtgttgtcctcatagacaagaaagctgaggtttagaggttaaaatgacacattgggggtaaataacagacactatatgttggagttgggaatcagatccaagtttgactccaaacccacttttaccacattgcttttgatctaaacttctattttgctaaaatacccctcacagctagtcatccatatcattgaagcgctcatgatttgatagattaacctttcatttttttaggtgactctagttagaaagtcttatttcacaatctgattgtttctttaacttaggatccaaacatgtccaaaataatgcagagtacatatgcaatcactcgtttatgctgtctagtcatgcacttaaagcaattttcaaatgtactcaaagtctctaggcttcggtacccagggttgcttcaagtatttgttcatgacacgtcaactcgatgattaaaatccttcaacacttctcattcacaataagaataaaatctacatcccttaccattcagtatgcaaaacttaaaatacataactttacccttaaatattttttctttctctgacttcataagtataggttatacctctataagaaagaaggtaaaaaactctcaacaatcccttctttcagagagaactactgttaacattttaacagacaacttcattcttttcctattcttttttataatgcttacaggaatgttaaatacttagacagatcttaagtacactagaattatctgtccctgaaataagttaggttgccctgccgcagaatttgtatctatagtttatttggattatttttgaaaaaagtaaaataacaatacccttacgaattttttggtgcatagcatctcagcttcttttatcattaaagatgtatgtataaaaaaaaaatgagtgtatatcaagttgttcatttcttagtttctggggtcttcttaaccagtacatagaactctttatgaattaactttagcttatgttggaagtagtagtttgtttatagtgtcatggattttaaaatcaaactcagtttttatttcttcactaaaacctattttcatatgatatacatgttaaatttcccttttattttggtcatgcatcaaaataaatttactaagtactaaagagccaacattattttataagtgcctggcaataggtattcactagttgaatagtttaatttgaaatgaattaattttaaatgggagttgttcaaaactatgccactttttcttttgtcctttgtgttattaaaatttaattgataattgtgtatattatatatatggagtacaatgtgatgttttgatatatgtttacagtgtagaatgattaaatcaatgtaataaatttattgcctcataccattttttgtggtaaaaaaaccacttaaaatctactcttaatatttttgaaatgtacaatgcattatttattatactcaccattctgtgtaatagatcagtaaagtttattcctcttgtctaa

SEQ ID NO: 961 - DNA, 2413 bp, Homo sapiens
gccacagggacagccggtgggctcggtggggctgcagaaggtcggggctgcactgctctcggcccccacacggttggttggttggcgtggtaagtgccctgatccctggtcctgagaactcaggctggcacagggattcccagggcatctaccaccacgcagctggagcagggctgagcccaggagcatggagatggacgcccccaggccccccagtcttgctgtccctggagcagcatcgaggcccgggagggctgccatcagcagcagtgagccatcacctctgctggccacattgtgttttttctcctagaactgtggacaacggaaggctgagccccatccattgagttcctggggccccactggaggggctgctgtggccagggtgcacggtcacaaatgaagacaccaaggcgcagagaggtgactcagcctgccctcagtcacctatctgctcctggaggtgatccccgactccatgaggaagcaagaggtgcggacgggcagggaggccggccagggccacggtacgggctccccagccgagcaggtgaaagccctcatggatctgctggctgggaagggcagtcaaggctcccaggccccgcaggccctggataggacaccggatgccccgctggggccctgcagcaatgactcaaggatacagaggcaccgcaaggccctgctgagcaaggtggaggccacccgcgggggcgggcaccccgccaggaccgtcgccctggaccggctcttcctgcctctctcccgggtgtctgtcccaccccgggtctccatcactatcggggtggccggcatgggcaagaccaccctggtgaggcacttcgtccgcctctgggcccatgggcaggtcggcaaggacttctcgctggtgctgcctctgaccttccgggatctcaacacccacgagaagctgtgtgccgaccgactcatctgctcggtcttcccgcacgtcggggagcccagcctggcggtggcagtcccagccagggccctcctgatcctggacggcttggatgagtgcaggacgcctctggacttctccaacaccgtggcctgcacggacccaaagaaggagatcccggtggaccacctgatcaccaacatcatccgtggcaacctctttccggaagtttccatctggatcacctcccgtcccagtgcatctggccagatcccagggggcctggtggaccggatgacggagatccggggctttaacgaggaggagatcaaggtgtgtttggagcagatgttccccgaggaccaggcccttctgggctggatgctgagccaagtgcaggctgacagggccctgtacctgatgtgcaccgtcccagccttctgcaggctcacggggatggcgctaggccacctgtggcgcagcaggacggggccccaggatgcagagctgtggcccccgaggaccctgtgcgagctctactcatggtactttaggatggccctcagcggggaggggcaggagaagggcaaggcaagccctcgcatcgagcaggtggcccatggtggccgcaagatggtggggacattgggccgtctggccttccatgggctgctcaagaagaaatacgtgttttacgagcaagacatgaaggcgtttggtgtagacctcgctctgctgcagggcgccccgtgcagctgcttcctgcagagagaggagacgttggcatcgtcagtggcctactgcttcacccacctgtccctgcaggagtttgtggcagccgcgtattactatggcgcatccaggagggccatcttcgacctcttcactgagagcggcgtatcctggcccaggctgggcttcctcacgcatttcaggagcgcagcccagcgggccatgcaggcagaggacgggaggctggacgtgttcctgcgcttcctctccggcctcttgtctccgagggtcaatgccctcctggccggctccctgctggcccaaggcgagcaccaggcctaccggacccaggtggctgagctcctgcagggctgcctgcgccccgatgccgcagtctgtgcacgggccatcaacgtgttgcactgcctgcatgagctgcagcacaccgagctggcccgcagcgtggaggaggccatggagagcggggccctggccaggctgactggtcccgcgcaccgcgctgccctggcctacctcctgcaggtgtccgacgcctgtgcccaggaggccaacctgtccctgagcctcagccagggcgtccttcagagcctgctgccccagctgctctactgccggaagctcaggtggataccagggcagggggcaggggctggggaaggggcagaggagagagcagaagccgtcccctccccaccaccaagcttctctgtcagtctcctagggctgccgtaa

SEQ ID NO: 962 - DNA, 3063 bp, Homo sapiens
acgggatgtaggcggcggcggcggtagtggtagcggttattcggcggcccgcggcggaccatggccctggccctggcccggcgtcgctgggctttcctcacggcgtccccgagcagcgtcgcagagcgggccgacttccgggaaggaactgaccagcgactgagcggcggccggcgcgcttagcgccctgaacatgcggcagtccctgcgggcgaccccgggctccggacaggcggcggcggaggcggcggctcgggagggaaggaggcggcggcgccggcggaggtggcggcggagacggccggcgcccggcgcggagccctagggaggcagttcagcgcggcctcgggcctcgtcgagaaggatgctgtcccgaaagaaaaccaaaaacgaagtgtccaagccggccgaggtgcaggggaagtacgtgaagaaggagacgtcgcctctgcttcggaatcttatgccttcattcatccggcatggtccaacaattccaagacgaactgatatctgtcttccagattcaagccctaatgccttttcaacttctggagatgtagtttcaagaaaccagagtttccttagaactccaattcaaagaacacctcatgaaataatgagaagagaaagcaacagattatctgcaccttcttatcttgccagaagtctagcagatgtccctagagagtatggttcttctcagtcatttgtaacggaagttagttttgctgttgaaaatggagactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcaggtattgggagagttgctgctacatctttaggaaatttgactaaccatggttctgaagatttaccccttcctcctggctggtctgtggactggacaatgagagggagaaaatattatatagatcataacacaaatacaactcactggagccatcctcttgagcgagaaggacttcctcctggatgggaacgagttgagtcatccgaatttggaacctattatgtagatcacacaaataagaaggcccaatacaggcatccctgtgctcctagtgtacctcggtatgatcaaccacctcctgtcacataccagccacagcaaactgaaagaaatcagtcccttctggtacctgcaaatccatatcatactgcagaaattcctgactggcttcaggtttacgcacgagcccctgtgaaatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaagtactctggttaataaatgctgcttcctttgtggaaattataaaattctaactttacatgtattttgttattagaaattttcttttattgaatgagaaaaattagtctatcattttaagagccaatatggcaaacactttcaaatactgtatattaggaaactgttttggtattcttgatggaaaaaaacgcagcggaaatgtcattatgaacagatgttaaataggaaattattacttgttaacttcttacagcagtagtaccttctttaaaaaaaaaaaagaatctgcggtatttttttaaaaaaaaagtttaccgctgtagtgtgaaatattgtctggaaagggatggtttaaatattaccatgatgtagttgaaatataaaataggatttggaaccttattgtgataaatatttatatatgatgtatgtttgtctcccctctccaaagtaaggaacccagctgggcgtggtggctcactcctgtaatcccagcattttgggaggccgaggtgggtggaccgcttgagtccacgagtttaagaccagcctgggcaacatggtgaagccccatctctacaaaaaatacaaaaaaattagccgggtatgatggtgtgtgcctctagtcccagctacttgggaggctgaggtcagaggatggcttgagcccaagaggcagaggttgcagggtcaagatcgcaccacttgcactgcagcctgagagagagagagccagaccttgtctcaaaaaataaaaaataaaaaaataaaaacaaaataaggaatccttttaaagcatgttgagaaagtattttttggtatgaatgggtgacgggccttttaatctttcaggaatacatataagcaggaatacttagcctgtattgggaaggtgcgtgaaactcaaagttgctaacatcatcttccttattttcagccagtgctgttactgcatttagcatggctctgacgaggcagtggagagttcctgacagcatagcatactgccttctgacagactgggttaagctaccaaaaatgacaaccagggattcaaaaaaaatttttggtcattaaatcgaatgtatattattactttttaattttctaagtatttatcacaggactttaacaccatatatttccctcccagtttttctccccttttggtttaatagttaaaacatttttcataattagtgctgtacatttgattgcaaacaaattggtgatacttctaaactataactataaatctctagaattctgtgaatttcaacattatttgaagtagttcttcagttatatttacatgtgttgtaaatatgtaaatatacttttagcttaggaagtcttccagaatacaaactactcccagttagatatcagtgagtttgaataactgaagaaatgttgacaatgttaagtgtttgattttatataacaagcttattaaatatatttttgtggaaacta

SEQ ID NO: 963 - DNA, 2891 bp, Homo sapiens
ccacccgcctctggctcctctccttcccacccctgccgtgctccggcaggaagaggtggtgccagggccgttgctaggatacgaccaacagctgagaacgcggcgagtatggaagctgcgtcttaggagcctgggaaagcacttcgacgagaatagtttggtttcgtacacaggaaaatgtctaatcaacaggagaagtatgaagctcagaatatagtcaattcaacagaagagagtgatgatgcttttgatactgtcactattccagttccctcagaagagcctcaagagtcagatcaaactgaagagcatgaatctggaatagaacaattcagtgagagccatgcaatacatgttgaggagcagagtgaccaaagcttttcaagcctggaaccagacaatgaacaactcatggaagaggttatatcaccaagacaagtttcatatactccgcaacatcatgaaaagcaatatgcaatgcagaggccaaatgatgatagtttggcatttctggataaaataaagtctgtaaaggaatctttgcaagaatcagtggaagattctctagcaacagtaaaagttgtacttattccagtgggccaggaaattgtaataccttttaaggttgataccattcttaaatatcttaaggaccatttttcacacttattaggtatcccacattctgtactgcagataagatactcaggaaaaattcttaaaaataatgagactctagtacaacatggagttaagccacaggaaattgtacaagtggaaatcttttctacaaatccagatctgtatccagtcagaagaatagatggattaactgatgtctctcaaatcataactgtcactgtccaaactggacttgatcaataccagcaggtacctgttgagattgtcaaatctgactttcacaaaccatttcttggtggattcagacataaagtaacaggagtagagtatcacaatgctggaacacaaactgtacctaaaaggattcccgaaagactcagtatattttgtagggatacgcagacagtttttcagaaaaaaaatctccaacaaactacaaatacaacatccacacagatgactaacattggtgtatatgtatcaaatatgactgataaactggtaacaccaggaaagtatttttcagcagcagaataccatgctcaaagactaaaggcggtgatagtgatacagacttactacaggcaatggcatgctaaaatcttcgtagagaatttaagaagacagaaaagcttaagactggaatgggaaacacagcaagaactaaggaagataagagaaaaagaagaatggataaaattggactatcaccggaggcataatcctaaaacaaatgaagattttgaatttctttataatgcattagaattctggcggcaagaagaacttacacgtattaaccaatcttttactggagctgaaaggaaagctgctctgtgtgaacttctggaaaaagagactcagataattgcttccattgggagacatagatacattgcttatatggcaaatcaggaagcagcaatacaagcttttttggataagtgttcagctccaaaaatatggagaacccctaatggcaaaacaattgagatggatacgcagttcaccatcagagccagagagctgcaaaatatctataagtgcattatgctgaaaaatatctcccaagatgagaggctggatgtgctgttaactcttaaacacactgtaaaggaacatgaatgtaaactaactcaggaaattctagaattgattgacagagaggttgaccttatgatgagaggagtcaaacatcataaccttgaaggactcagaaaaagaattgcgacactcttttttcattatatcaaaacacctctgtttaatcctgaagttgcaaaataccttaaggtccctcaagacccattgaaattttataagaagatttacttttgccacagttgccagctttatttgccttctacagaattttctgtatcatccacctcacgccgcatataccggtgtcgtaactgcattaaccttcagaatgaggctcaaaaacgagaatcatttttgaagtacaaatgtttacttcaacagctctactatacagaagctgattatgaagatgattctaaaattgctttcttgatgcagctacaagacattcagtacctgacagagaacatctgggcgtcccagtcagtcctcagtgcttgcgacaatctcagtgatctggtcatggtcagatggaataaatccctggagtggtccccctggaactgcattcttcttaccaaagatgaagcagctgctcatctcaagctaacaagtattgaagagggatatgaacgctcatttattcacaagatcaaacacaaacatatcctggctaagaactatttttctcaggttccagtgctggcttcatttatacttgatgatggtgaaattgatgagatcagatggaagtatcactcagacacaacacctaagattatagaatcccagaggcctcctcattaggtgatccaggagtatttgtttgatgatcggcattttgttcactgctaatagggtaatacagaggtcacagagtatggaaatggaatttaatctgtttattgattttgttttttgtttttcatagtattttgagttatataaagagaaaacatttctatataagtaagtattctttgttaggaagttggtgctaaattgaaatgcaattttgttactgaaattaatattttggggtaaagaaaacattttaaaatgtgttttcacattaaattttttaaattttttcaagtatattagagttaaaatctaacaaacagccaaataaaaactagacaact

SEQ ID NO: 964 - DNA, 5598 bp, Homo sapiens
gagcctggggaggtcgagggtgcagcgagccgtgatcgtgctactgcactccagcctgggcaacacagagagaccctgtctcaaaacaaacaaacaaacaaacaaacaaacaaacaaaaaaaacaaagaaaaaaaaatgggagtgggccgggcgcggtgactcacacctgtaatcccagcactttcggaggccaaggcgggtggatcacgaggtcaggaattcaagattagcctggacaacatggtgaaaccccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggt

SEQ ID NO: 965 - DNA, 2433 bp, Homo sapiens
ggagacagcggcgtggcggcggcggtggcggtagcgacggcacgccgtagggcggtcagaaggtttccggttccggtgtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaaggaggtgtttggtgatgactctgagatctctaaagaatcatcaggagtaaagaagcgacgaataccccgttttgaggaggtggaagaagagccagaggtgatccctgggcctccatcagagagccctggcatgctgactaagctccagatcaaacagatgatggaggcagcaacacgacaaatcgaggagaggaaaaaacagctgagcttcattagcccccctacacctcagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatcttacagaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaaagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgacaggggtggtggtactgcacaaggatgtcaacgtggtagtagtggaagggggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 966 - DNA, 2950 bp, Homo sapiens
ctgggagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtgcagccgctgcattttttaacatgggatacctgttattttcattatttagtcccaacccctatgtctccctcctcgaaatcagtgagcactcccagtgaagctggaagccaagactcaggcgatctggggccattaacaaggaccctgcagtgggacacagacccctcagtgctccagctgcagtcagactcagaacttggaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagcttgcagttccccacaatgatgaatggacccgatttgccaggacccttgtggaaattcgtgctaacagagctgatagcgaggaggaaggcactgttgagttatctgcctagtggaaatgagccacccccactgcagcccccacctttgtgtcctagagctcagcgtctgcagtcaagtctcttgtattcggtgtccattcagtatcagtattgctgtgatattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtacagggccaaagacttgagacgtggtgttttacatggtgactcacattatgaatggatttactagaagaacattgctgctccttatttattgtagtgtgctgcatggaacgtatttatttgaaagcattaaaataaatgatcctagagcatgtgcataatgagaggactgtattctctctgctgctgttgaggttatattaagttccacatagcaattacagtatgccagttccactgaagacatgaaatctttagaggtttcttgcagtgaacgaaatgaattttaatgcctattatttctgggtactttaacaatatttcaaatatcattgaccactaatacttctcactgaagctaacacagtctgacaaaagtctatggttcctaaatatgacatcagtgttgccaataaaa

SEQ ID NO: 967 - DNA, 8055 bp, Homo sapiens
atgacggaagtgacggcggctcggcgatggctctcccgcaggcgcagaaacggctgctgggcagctgatgggcaggagcttaccaggctggcttgctctgagctgcggttactgtgtccaggccccgggttctcagaactgtcatacataaagtacacagaaatgaagagaaaagtcgtgaatactcacaagctgagattgagtcctaatgaggaagccttcattttgaaggaagattatgaaagaaggcgaaaactaagattgctacaggttcgagaacaagaaagagatatcgccttacagataagagaagacataaaacagaggagaaatcaacaatttacacgtttggcagaggagctaagggcagaatgggaagaatcacaaactcagaaaatacagaacttggaaaaactgtatttggcaagtttaagaagtatgggagagggacatcgacaggccaaagaaaatgaacctgatttggatgctttggcacagcgggcagcagaaaggaaaagaaaagcagatttgaggcataaagaagccttgaaagtacagaaaaatcaaaaagaaatattactgaaacaaaaaacctggcatataaaagctcgaaaggaagcactgcttgtggaaaaagagagatcagccaaaattacaagtctgccacctcctcctccaactctttttgagaacatcgaagtaaaaagaatttctgcagtcaaaaccaatagttctacctaccatcatcttcacacttttgtgaatagagagacagacacaaaacggccagatgctcgtttggctgctgaagaggaagctaaacgattggaagaactacaaaaacaggcagcacaagagagaatggaacggtttgaaaaggcacatgtacggggattccaagcaatgaagaagatccatttggctcaaaatcaggagaaactaatgaaagaactcaaacagctacagcaagaggacctggcacgtaggagacagactgtagcacaaatgccaccacaactagttgaacttccatacaaacgcagtgaaatgaaagaagactggcagagagaattggaatttgcctttgaagatatgtacaatgcagacaggaaggtgaaagggaatctgattctgcaccttgaaccagagcccttgcccactgtgactaatcagatccaagatgaagagctggacctttcaatggaacaagaaaatttgggtgcagctgaagaccttccagtgacagaagctgaaatatgttctagtgaaacagatgttcccttggtaatgaagacccaacagattccttcaaaagttctttttaaaaaattattaaataagatccgaagccaaaaatctctctggacaattaaatctatgtctgaggatgaaagtgaaatgattacgactgttagtgaaattgagagtaaagcaccaacggttgagtcaggaacaattgccagcaaagagagaacgttatcctctgggcaggaacaagttgttgaaagtgatacactaacaattgagtctggaccacttgctagtgaagataaaccactttcgtgtggtacaaactctggaaaagaacaagaaataaatgagactctgcctatcacaactgtagctcagagttcagttctacttcatcctcaagaagcagcagccaggattagaatgtcagcaaggcagaaacagataatggaaatagaagagcagaagcaaaagcaattggaattacttgaacaaattgaacagcagaaattaagattagaaactgactgcttcagggctcagctggaagaagaaaaaagaaaaaaaactcaaccgactggggttggcattgctccagcatcatgccctgtaatttctgatgaagatagtcataggcagatgattcgtaactatcaacatcagcttttacaacaaaacaggttacacaggcagtctgttgaaacagccaggaaacaattacttgaatatcaaactatgttaaaaggaaggtgcccatcggtgtcagctccatcattgataactgattctgttatatcagtgccatcatggaaatctgagagaccgactgctatatcagagcattgggatcaaggtcagagactcaagttgagtcctaacaaataccaacccatacaacctatacagacctccaaattagaacaagatcattttcaggtagcgagacaaaatcactttccacaaagacaggtggaaacaacagaaacattacgcgcttcagatattttaaccaatcaagctttagaatcacaagaacatctaaggcaattctctcagactgaaacacaacagagagactataaattggtccccaaagattctgagacactttcaagggctttgtcacatgacaggcagctaatatcacaggatgctagaaaaatatctgaaacatttggggcaacaacttttcaaagtttagaatcccaacaattgttctcagagaatagtgaaaatatatcttaccatttaactgaaccttcttcatttgtaccactggtacctcagcattcttttagttctctgcctgttaaagttgagtcaggaaaaattcaagaacccttttcagccatgagcaaaagtacagtttccacaagccattctataatcagccaaatgcatgataggcctttgctgccgtcagagaatatcacagcccagcaaggtaatatgaaggccctccaagaacagttagacctacagaagaaagttcttcaggcaactcaggaagctcaggaacagttgcttttgtgcaaacagaaagaagtggaacagcaaacgggcctctcggtattccttcccttggtaactccagattcatctgctttattgccttctgccaaagcagatttggggagaatccaggaatcttcaccaaccaagaataatattgcagtttcctcagaccatcatgtgatctcacaacttcaggataagcgtttgagtctttcacagcctatcctatcacagcaaaataattttaaatttctccaagagcagttgaatattcagaaggatagccttcaggctaggcgagaagcccaggaagtattgtatgtacataaacagagtgaattggatagaagagtatgttccgaacaggctgagccctctttcccatttcaggtagctcagcatacatttacttcactaccatctgctgatacaaaatctggaaaaatacaggagcaacattcatctaagagcgagaaaggacttgtttcatgccaatctgacatccccatatctcaggatgggtctttgagtttcctacagcagttcctacctctacatgatagtttgaagttgctccaagaacagttgactaaacagagggatactcttcaggctaggcatgaagctcaggtggaattacttttacatagacaaagagatttgggggacagtaagtctgggctggtgagctcttcatcctcaccagtggttgttcagcattcagttgcttcacaagcttctgctaaagctgagcctaggagaattcaggagctttatttatctgagaaggagaatgtaggtccctcctgtcatttgataatcccaacatttcaggataagtctcttagttttccacagcatagcctggcacagcaagaaaatttgacaatactccaagaacagtcacaaatacaaagggtaatacttggtgctaaagaaggaactcaggaatttgtacacacagaaagtgaattggagaaaagaatttcttctgaacagactggcacctcctcatccctttcccaggtggatgaatctgagagattccaggaatgtatatcaatcaagagtgacagtaccattcccttaagccatcctaagatcccaagatgtcaggaaagacttttgagagtttcacaacatatgctacctctacaagataatttggaggaacaccaagcatggctagacactgagaaagaagcctttcatttcagccagaaaacccaagaaaatacatcttctgaacaaactggttcatcttcattcataccccagttggtacagctttcatttacttcgttagcttcagctgagtctggcacaatcctggaacctctttttacagagagtgaaagtaaaattttttcaagccaccttcagatcccacaattgcaggataggcttttgaggatatcgcaacttatccagcctcaacaagataatttgaaggcacttcaagaacagttagctacacagagagaagccatcattctagctagacaagaagctcgggaagaattacttttacatcagagtgaatgggagggaagaatatctcccgagcaggttgacacctcttccttacccctagtaccacagcattcattcgcctcattacctcttaatgaatctgaaagaaaccaagaaccatgttcaattaacagtgataatatagtatcctcaggtcactcagagataccaacattgcctgatgggctgttgggtttatcacatcttgttttacctcaacaagataatttgattgcacttgaagaacacttgcatgcacagacagatttccttccttctattgagaaaacccagaaagaattggttttgtcaaaaccatgtaaatttgaggaaaaggtatcttctgagcattttatccagtctcaccatggtgatttgcaggcacttcaacagcagttagatacacagaagaaagccattcgatctatacaggaagtccaagaagaattgcttttgcaaagattaagtgaattggagaaaagggtatcatctgaacaagtttgctcctcttcatttgtatcccaggtgcctgttgctgactctgaaagaacccagaagtctttcccaaccaaaagtaatgatactcttccctcaagtcatcgtgagattccaagattacaggatagacttttgagtttatcaaagcctattctgcctcagcaagataatatgacagcacaattggatgcacaaagggaagtgatgtattcttatgagaaaccccaggaagaactgtctttaaacaaacaaagaaagttgaacaaaagtgaatctgctgagcatactatcccctctttgtttctacccaaggaaacagagcattcgtttattccactaccttttgcagaagctaaacctaaaagcacttgtgaattgtattcatcccagaatgaacatgcagcccccccaagtaatcctgtgatcccagggtttcaagatagacttttgagtttttcacagtctgtcttaactcagcaagataacttgggacttcagaaacagttggatctacaaagagaagttctgcattatagccagaaagcccaggaaaaattgcttgtacagagacaaacagcattgcagcagcagatacagaaacatgaagagactttgaaggatttctttaaagacagtcagataagtaagcccacagttgaaaatgatttaaaaacccagaagatggggcagctcagagactggtttcctaatacacaagacctagcaggaaatgatcaagaaaatattaggcatgcagataggaacaactctgatgataatcatttggcttcagaagatactagtgccaagcaaagtggtgagcatctggagaaagatctggggagaagatcctcaaagccacctgtagcaaaagtcaaatgtggtttggacttaaaccagcatgaacttagtgctatacaagaagtagagtcaccagcaattggcagaacttctatactaggtaaaccaggtatttatgaagacagagaccccctgcgagtctcaataagccgagaacaaagtttctttgggagcccactggcccatgatccgtttagttgtcttcaactggttggccaagagaatgtctgtggtgatgactatgatgaagcagttaagctgaaggaatctgttgttgaaaatcatgcagtgttaagttatgctgtggaggaagaacatgcatatttgggtccaactgtgaagccagatgataaggctaaaacactgtcttatgaaccattatcttcagcaactgtttccactgggagccttttaagttatgaaaacacagatttgagccttacagatccagagtcattttcagagcacatggatgatagcaagcaagaatctaccaccagtaaagaagaggaaacaaatattataagttccatagttccttcaacacaagatatttatcagcggcagaactcttcagacgttcataaatctctgttgcctgcagtggatgaaactacatgtggtcacacacactttcagcaaatgatagacaagtacattaatgaagcaaatttgatacctgaaaaaacagatttgcaagaattggaacacatttttcctaatttgcatcatcagctgtttaaacccttagaaccacatccagattttgacttatcatcatcatcctctgggatttctccagacaacagagacttttaccagagatcagattcttcatctgaaagccactgtgctactggattatccaaaagtacagtttatttcacagcactgaggaggaccagcatgcattcttctcttaacacaagtccgaatcaacaacctgacactaacttggctcatgttggagctcacagttttgctacagaaaatattattgggggatctgaacaatgttttgaacagcttcagccagaatattcttcacaggaggagagccagcatgctgatctaccaagtatttttagcattgaagcaagagattcttcccaaggcatgaaaaatcagaactatccctctgaagaacatactgaaatattacaaaacaagaaaaaaattgttcatttccagctttctataggaaacttaagttcagtctacagttcatctgatgaagctaatgtatttgatcagttaaatgtacagcatagcactccatgtggttctaactctagtgagtgctcaacaaaacaccaactagaaagcagaaaggaaagtatgggctttgaagaactatcaaaaagaggggttgttacaatgttacaaagtcaaggactcattgaagataataaaaatgaaacctgtagggttttagacataaatccacaggtagaggaaactgactctcgattatgtgtaagaacagtggagatgggaacttcaattcaggcaccatattccttaactactcaaaatgaaaaatattttgagaattcagctgaaacagacattccaaaaatcaccaaaaaactatctcaactaggagaatcagagctttttgcaagttctggatcattttcattacagagctctataccagtctgggaaacagaaactggccatggtataatggaagaaccagaacttactttaataagcaccactgataccagtattgctgaaatggattttgcaaatttaaccctagaagagaagagcgagaatgaagcaaaatgcttctttcaggtgagtgagtttctgcctcttgtatcagcaacagaagcctcagattatccagctgtatcagaactttccatagaaaaaccaaggacagcatctacagaaacccctcgcaggcttacacctgtaccagggagcttacaagaagcatttataaagaggaaaaaatcatttatggagagatcccaccagaggcagaaagaaataaggaataaaattcatgtctctgaaaattctcaaatcaaaacagttaaagagaaaccatctataagttcatctgtgagtcgtctaaagggcgtgaataaagtcagagcatcttttcctgaagacagaaagactacacaggctctaaggcaccaaaggggtctaaggttatacaatcaactagctgaagtgaaacaacaaaaggaagaaaaaacaaaacaagaagcttatgcccaaaacagagcaagggcaaaagaattccataagaaaacactagagaaacttcgagccaaaaatacatgctgactttctagaaatagtgtaaaggttttttaattgtgtatatgtagcattagacaaaattatttaaagtcaataaattgttattcgagg

SEQ ID NO: 968 - DNA, 2857 bp, Homo sapiens
ctcttggcgggtgccggccatggcggcttcgctcccgggacctgggagccggcttttccgcacatatggggctgcggacggcaggagacagcggcggccgggccgggaagccgcgcagtggttcccgccgcaggaccggaggcgtttcttcaacagcagcggcagcagcgacgccagcatcggcgacccctcgcagtccgacgatcctgacgatcccgacgaccccgacttccccggcagcccggtgaggcggcggcggaggcgtcccggcggccgagtgcccaaggaccggcccagcctgaccgtgaccccaaagcgctggaagctgcgagctcgcccaagcctaaccgtgaccccaagacgcctggggctgcgagctcggcccccgcagaagtgcagcacaccctgcggcccgctccgacttccgcccttccccagccgcgactccggccgcctcagcccggacctcagcgtgtgcggccagcccagggacggcgacgagctgggcatcagtgcctccctgttcagctctctggcctcgccctgccccgggtccccaacgccaagggacagtgtcatctcgatcggcacctccgcctgtctggttgcagcctcagccgtcccgagcggcctccacctcccagaagtctccctggaccgagcatctctcccctgctcccaggaggaagcgacaggaggagccaaggacaccaggatggtccaccaaacccgcgccagcctcaggtcagttctctttggccttatgaactcaggaacccctgaggattctgagtttcgggcagatgggaagaatatgagagagtcctgctgtaaaaggaaactggtggtgggaaatggaccagagggtccaggtctgtcaagcacaggcaagaggagggccacaggccaggactcttgtcaagagagagggcttcaagaggccgtccggagagagcatcaggaggccagtgttcccaagggccgcattgtgccaaggggaatagacaggctggagagaactagatcaagccggaagagcaaacatcaggaggcaacggaaacctctctcctccattcccaccgctttaaaaagggccaaaagctgggaaaagattcgttccccacccaggacctgactcctttacagaatgtctgcttttggaccaaaaccagggcttccttcagtttccacaagaagaaaattgtgactgatgtgtcagaggtctgcagcatctataccactgccacttctctctctggatccctcctatcagaatgttcaaaccggcctgtcatgaacagaacaagtggtgctccgtcctcttggcactcctcctctatgtatttgctaagccccttaaacactctaagtatttcaaacaaaaaggcatctgatgctgaaaaggtttatggggaatgcagtcagaagggtcctgtcccctttagccattgccttcccacagaaaaactgcaacgctgtgagaagattggggaaggggtgtttggcgaagtgtttcaaacaattgctgatcacacacccgtagccataaaaatcattgctattgaaggaccagatttagtcaatggatcccatcagaaaacctttgaggaaatcctgccagagatcatcatctccaaagagttgagcctcttatccggtgaagtgtgcaaccgcacagaaggctttatcgggctgaactcagtgcactgtgtccagggatcttaccctcccttgctcctcaaagcctgggatcactataattcaaccaaaggctctgcaaatgaccggcctgatttttttaaagacgaccagctcttcattgtgctggaatttgagtttggagggattgacttagagcaaatgcgaaccaagttgtcttccttggctactgcaaagagcattctacaccagctcacagcctccctcgcagtggcagaggcatcactgcgctttgagcaccgagacttacactgggggaacgtgctcttaaagaaaaccagcctcaaaaaactccactacaccctcaatgggaagagcagcactatccccagctgtgggttgcaagtgagcatcattgactacaccctgtcgcgcttggaacgggatgggattgtggttttctgtgacgtttccatggatgaggacctgtttaccggtgacggtgactaccagtttgacatctacaggctcatgaagaaggagaataacaaccgctggggtgaatatcacccttatagtaatgtgctctggttacattacctgacagacaagatgctgaaacaaatgaccttcaagactaaatgtaacactcctgccatgaagcaaattaagagaaaaatccaggagttccacaggacaatgctgaacttcagctctgccactgacttgctctgccagcacagtctgtttaagtaagctaaatgtatcttactgccccgaaatgagaggagactggtcttgaagcctctggtgctgtttcaacctccatccccacaggagggtggaactcccattctcacaggtttccagtcagcttttcaaacaagaattttgtttccaaatggaaactgaaatatttgttgaaatgtttaaatttgctgataacaaatgttctgaaagaagtaaactagccgggcacagtggcgtgcgcctgtagtcccagctactcgggaggctgaggcaggaggatcgcttgagcccaagagttcatatctagcctggtcaacatagcaagacccctgtctctatttttttaaataaataaactacatgtgaaaacaaacgtttatatttataaaccctcttttttttttttttaattttattgagacagagtcttgctctgtcacccaggct

SEQ ID NO: 969 - DNA, 1855 bp, Homo sapiens
aggcgcagtcccgcgttccctcggcggctgccggcgtagtgagcccgccgccgtggagtgtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaaacctgaaataaataaatgttagattg

SEQ ID NO: 970 - DNA, 1880 bp, Homo sapiens
agggaagtgaagccagtaggagactgagagattagaagaacagggcagtagaggatgaatttgcagtgaggttaaaggaacaatttattgggagaagggaatgtaggagggtagaagactttaaaattgaaaagaaataaaaggaggcagggatgtaaaacgagccataagtacaatgacaaatgggcattaaggaggaaaaagactatgtagaagaatctggtaaatatggatattaacagcaataagctcctttttaacgatttaattctaccaagtaaatatttgggattactcgctttttgccttttatttaccaaaaaattcatatattttcaaaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaa

SEQ ID NO: 971 - DNA, 3825 bp, Homo sapiens
gagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagcattgtga

SEQ ID NO: 972 - DNA, 7697 bp, Homo sapiens
agtgccctgggacacctcttcagtccgtggactttcccgctgcacactgccctccgaagtcggggacgcgggctcgtgagatggaagattttcgaggtatagcagaagaatcatttccaagctttctcaccaattcattatttggtaacagtgggattttggaaaatgtcactctttcttcaaatcttggcttgcctgttgctgtttctacacttgctagggatagatccagcactgataacaggtatcctgatatccaggcatcttacttagtagaagggagattttcagttccatccgggtcatctcccggaagccagagtgatgctgaaccaagagagaggttacagcttagcttccaggatgatgattctatctctaggaaaaagagctatgtggaaagtcaacgtttgtcaaatgctctcagcaaacagtcagctttacaaatggagacagcaggaccagaagaggagccagccggagctacagaatccttgcagggccaagatctcttcaacagggcttcaccactggaacaagcacaagactcacctattgattttcatttacagtcatggatgaataataaggaacccaagattgttgtgcttgatgctggaaaacattttgaagacaagactctaaagagtgacctaagccacactagcttattagaaaatgagaaacttatcttaccgacaagcttggaagattcttctgatgatgatattgatgatgaaatgttttatgatgatcatttggaggcttattttgaacaactggcaattccaggaatgatatatgaagacctagaaggaccagaacctccagaaaaaggttttaagttacctacaaatggtcttagacaggcaaatgaaaacggtagcttaaactgcaagtttcaatcagaaaataacagctctctgatttccctcgactcacactcttctgaaacaactcacaaagagtctgaggaaagccaagttatttgtctacctgggactagtaattctataggtactggagatagtagaaggtacacagatggtatgttaccattttcctctggtacttggggaactgagaaagaaatagaaaatttgaagggtattgttccagatcttaacagtgaatgtgcaagtaaagatgttctggtgaagaccctcagggctattgatgtgaaacttaactctgataattttcatgatgcaaatgccaatagaggtggttttgatctgactgaccctgtaaaacagggggcagagtgtcctcaccaaaataagacagttttgcacatggatggatgtttagacactgagactcctacggtgtccattcaagaaaatgtggatgtagcctctttgaagcccattagtgacagtggaattaatttcactgatgccatttggtcaccaacttgtgaaaggcgaacatgtgaatgtcacgagtccatcgaaaagaataaagacaaaacagatctcccacagagtgtggtctatcaaaatgaagagggtaggtgggtcacagaccttgcctattacacatcttttaatagcaaacaaaatttaaatgtgtctctaagtgatgagatgaatgaagacttcagatctggttccatcatttggctattttattagatcaccagagaagagagaacctattgccttaataagaaaatctgatgtatcaagaggtaatttggaaaaagaaatggctcatcttaaccatgatctatattcaggagatttaaatgaacagtcccaggcacagctaagtgaaggatcaattacacttcaggttgaagcagtagagagtacttcacaagtggatgaaaatgatgtgacgttaacggctgataaaggcaaaacagaggacactttcttcatgagcaacaaaccccaaagatacaaagacaagctaccagatagtggtgattctatgcttaggatcagcaccattgcttcagccattgcagaggcatcagttaatactgatccttcccaacttgctgcaatgatcaaggcactttcaaataaaaccagagacaagacttttcaggaagatgagaaacaaaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaagaaatacgagataacagagaaaatcagaggcaaaatgagtgtgtcagtgaaataagcaacagtgagaagcatgtgacttttgaaaaccatcgcatagtctcacctaaaaatagtgatttgaaaaatacctctcctgagcatggtggacgtggctcagaggatgagcaggagagcttcagaccttccacgtcaccactgagtcattcttctcctagtgaaatttctggaacgagttcatcagggtgtgcgttagagtcctttggttcagcagctcagcagcagcagcctccctgtgagcaggagttgtctcccttggtgtgctcgcctgctggggtgagcaggctgacgtatgtgtctgaaccagagagctcctatcctaccacagccacagatgatgccctggaggaccgcaagagtgatatcaccagcgagttgagtaccacaattattcaaggcagtccagccgcattggaggaacgggctatggaaaaattgagagaaaaagttccatttcagaatagaggaaaaggaacattatcatctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattggggagtgtccgagtgcccgaggagttgaagcttcctcatgcttgctgtgtcgggatcgcttcccagaccctcctcagtgtgcttaatccaactgaccgctggctgcaagtcagcattggggtcctcagcattagtgttaatggtgaaaaggtggatctttcaacatatcgttgtttagttttcaagaataaagccatcataagacctcatgccacagaagagataaaagtgctttttataccatccagtcctggggttttcagatgcacattcagtgttgcttcttggccatgttcgacagatgctgagaccatcgtacaggcagaagctttggccagcaccgtcactctcactgccattgccgagagtcctgttattgaggtagaaacagaaaagaaagacgttcttgattttggtgacttgacttatggaggctggaaagccctcccactaaaattgataaaccgaacgcatgccactgtgccaattagactgattattaatgctaacgctgtagcctggcgctgtttcacgttttccaaggaatccgtccgagctcctgtggaagttgctccttgcgctgatgtggtcactcggctagcaggcccttctgtggtcaaccacatgatgcctgctagttatgatggacaggatccagaatttctgatgatttgggttcttttccatagtccaaagaaacagatcagctcttcagatattctggactcagcagaagaattctcggcaaaagttgatatcgaagttgacagcccaaaccctacgcccgttcttagaagtgtgagtctccgagcaagagcaggaatagctaggatccatgctcccagggacttgcagacgatgcatttcttggccaaagtggcttcctcaagaaagcagcacttacctttgaaaaatgctgggaacattgaagtttatttggatatcaaggtcccagaacaaggaagtcacttttcagtggatccaaagaatctactccttaaacctggagaagaacatgaggttattgtttcatttactccaaaggatcctgaagcctgcgaggaaaggatcttgaaaatatttgtgcagccatttggacctcagtatgaggtagtgttaaaaggcgaagtcatttcttcaggaagtaaacctctgtcacctggaccttgcttagatattccatcgattttgtccaacaaacaatttctggcttggggaggagtccctctaggtagaacacagcttcagaaactagctttaagaaataattctgcatctacaactcaacatttacgactgcttattagaggacaagatcaggactgctttcagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacaatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctctggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagaggcttctgctcgcatacctgagcagcttgatgtgactgctcgtggagtttatgccccagaggatgtgtacaggttccggccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacataagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatattttaatgtggtatatcc

SEQ ID NO: 973 - DNA, 4842 bp, Homo sapiens
gcggcctccatgcgggcgtcaacgtccgatccaagcgccaaattcaaatttgcggccatcttgagcgggcggaattcagtcgcgcgcggtgcagtcgggaggtggaggcaccggctgcattgttttcgggatcgaggggtgagggcgctatggcacccggctgcaaaactgagttacgcagcgtgacaaatggtcagtctaaccaaccaagtaatgaaggtgatgccatcaaagtttttgtgcgaattcgtcctcctgcagaaagatctgggtcagctgatggagagcagaacttatgcttatctgtgctgtcctccacgagtctccggctgcactccaaccctgagcccaagaccttcacgtttgatcatgttgcagatgtggataccactcaggaatctgtattcgcaactgtggctaaaagcattgtggagtcttgcatgagcggttataatggtaccatctttgcatatggacagactggctcagggaagacatttactatgatgggaccatctgaatctgataatttttctcataacctgagaggagtaatcccacgaagttttgaatatttgttttccttaattgatcgtgaaaaagaaaaggctggagctggaaagagtttcctttgtaagtgttcctttattgaaatctacaacgagcagatatatgatctactggactctgcatcggctggactgtacttaagggagcatatcaagaagggagtctttgttgttggtgcggtggagcaggtggtaacctcagctgctgaagcctatcaggtgttgtctggaggatggaggaatagacgtgtggcatcaacatcaatgaacagagaatcgtctaggtctcatgccgtctttacaattacaatagagtcaatggagaaaagtaatgagattgtgaatatacggacctccctactcaacctggtggatttagcaggatctgaaaggcaaaaagatacccatgcagaagggatgagattgaaggaagcaggtaacataaatcgatcattgagctgcctgggccaagtgattacagcacttgtcgacgtgggtaatggaaaacagagacatgtttgctacagagactccaaacttaccttcttactacgggattcccttggaggtaatgccaaaacagccataattgcaaatgttcatcctggatccaggtgttttggggaaaccctatcaacacttaactttgctcaaagagccaagctgattaaaaacaaggcagtagtaaatgaagacacccaaggaaatgtgagccagctccaagctgaagtgaagaggctcaaagaacaactggcggagcttgcttcaggacagacaccaccagaaagcttcctgaccagagacaaaaagaagactaactatatggagtatttccaggaagcaatgttattctttaagaaatctgaacaggaaaagaagtctctgatagaaaaagttacccaattagaagacctcaccctcaaaaaggaaaaatttattcaatctaataaaatgattgtgaaattccgagaggatcaaataatacgcttggaaaagctccacaaggaatcccggggaggttttctgcctgaggagcaggatcgtttgctctcagaattaaggaatgagattcaaactctgcgagaacaaatagagcaccaccccagagttgcaaagtatgctatggaaaatcattccctcagggaggagaatagaagactgagattattagagcctgtgaaaagagctcaagaaatggatgcccagaccattgcaaaactagaaaaagctttctctgaaataagtggcatggagaaaagtgacaaaaatcagcaaggattttcacctaaagctcagaaagagccatgtttgtttgcaaacactgagaagttaaaagcacaactcctgcaaattcagacagagctgaataattcaaagcaagaatatgaagaattcaaagaacttactaggaaaaggcagctagaattggaatcagagcttcagtctttgcaaaaagcgaaccttaatcttgaaaaccttttggaagcaacaaaagcctgcaagcggcaagaagtttctcagctgaataaaattcatgctgaaacacttaagattataactacaccaaccaaggcctaccaacttcattcccgaccagtaccaaaattaagccctgaaatgggaagctttggctctctatacactcagaattctagcatattagataatgatatattaaatgagccagttcctcctgagatgaatgaacaagcttttgaggccatttctgaagagcttagaacagtgcaggaacaaatgagtgctcttcaagccaaactggatgaagaagagcataaaaacctaaagcttcagcagcatgttgacaaactggaacatcattctacccaaatgcaggagcttttctcatcagaaagaattgattggaccaaacagcaggaagagcttctctcacagttgaatgtccttgaaaagcagcttcaagagactcaaactaaaaatgactttttgaaaagtgaggtacatgacctgcgagtagtccttcattctgctgacaaggagctttcttcagtgaaattggaatatagttcattcaaaacgaatcaggagaaagaattcaacaaactttccgaaagacacatgcatgtacagcttcaattagataatctcaggttagaaaacgaaaagctgcttgagagcaaagcctgcctacaggattcctatgacaacttacaagaaataatgaaatttgagattgaccaactttcaagaaacctccaaaacttcaaaaaagaaaatgaaactctgaaatctgatctgaataatttgatggagcttcttgaggcagaaaaagaacgcaataacaaattatcattacagtttgaagaagataaagaaaacagttctaaagaaatcttaaaagttcttgaggctgtacgtcaggagaaacagaaagagacggccaagtgtgagcagcagatggcaaaagtacagaaactagaagagagcttgcttgctactgaaaaagtgatcagttccctggaaaagtctagagattctgataagaaagttgtagctgacctcatgaaccagatccaggagctaagaacatcggtctgtgagaaaacagaaactatagacaccctgaaacaagaactgaaggacataaattgcaaatacaactctgctttggttgacagagaagagagcagagtgttgatcaagaagcaggaagtggatattctggatctgaaagaaacccttaggctgagaatactttctgaggacatagagagggatatgctctgtgaggacctggctcatgccactgagcagctgaacatgctcacagaggcctcaaaaaaacactcggggctgctgcagtctgcccaggaagaactgaccaagaaggaagccctgattcaggaacttcagcacaagctaaaccaaaagaaagaggaagtagaacagaagaagaatgaatataacttcaaaatgaggcaactagaacatgtgatggattctgctgctgaggatccccagagtcctaagacaccacctcactttcaaacacatttggcaaaactcctggaaacacaagaacaagagatagaagatggaagagcctctaagacttctttggaacaccttgtaacaaagctaaatgaagacagagaagtcaaaaatgctgaaatcctcagaatgaaggagcagttgcgtgaaatggaaaacctacgcctggaaagtcagcagttaatagagaaaaactggctcctgcaaggtcagctggatgatattaaaagacaaaaggaaaacagtgatcagaatcatccagataatcaacagctgaagaatgaacaagaagaaagtatcaaagaaagacttgcaaaaagtaaaatagttgaagaaatgctgaaaatgaaagcagacctagaagaagtccaaagtgccctttacaacaaagagatggaatgccttagaatgactgatgaagtcgaacgaacccaaactttggagtctaaagcattccaggaaaaagaacaactgagatcaaagctggaagaaatgtatgaagaaagagagagaacatcccaggagatggaaatgttaaggaagcaggtggagtgtcttgctgaggaaaatggaaagttggtaggtcaccaaaatttgcatcagaagattcagtacgtagtgcgactaaagaaggaaaatgtcaggcttgctgaggagacagaaaagttgcgtgccgaaaatgtatttttaaaagaaaagaaaagaagtgaatcttgaggattccggtcagctacctaggcatcaccttgtttgaagatgtttcttctcttttacaagtaagacctactcctggccacttaggagagctgaatttatggaccttaattattaaatgtttataaggtggtggtaaccacctcaagtttctgatgaacattctgcatccatatacaccctgtgacagtcagcagtctgctattaagtggcctacttcaaggctttgaatcaacttaagggaaaaccttttgtctttgtaaaaataaaagcctgtagctaaggtttacagtggacattagccagatcattttcttcttagattatgccataatctcctttgattcttatggaagttctaacaatatatggtggttccaacacctgcagtgagtttaatgactgacttagtagcaggtacaagaagcaaacttgttaatatagattatttttgtattcttactttaggtattttcttgagcattttccatgactgtaaataaagccattttttaagataataattaaa

SEQ ID NO: 974 - DNA, 8723 bp, Homo sapiens
gtttgggaggcgcgggagatgtccaccctgggctggtggcgccgccgggcgccgggcgccatgagggtgcgctaggcggctgttcgtgcccgaggctgcgcagcactgaggtgagctttgccttcttgatcttccgtccttcttggagacgactggcgagaggaagagggactaggtccaaacgctaggtggctgggtccagatacctgtgttttgactctgttcctgtggatagctgcttggtctgaagttccagaaaggatcctgttcccagacaggtccctgagtactgacggtcacaggctgccgcgtctttcctgttgactcatgtttggttcctccagtgaaaattttacttagagaaatgctgcctccaaagcacttgtctgccaccaaacctaagaagtcctgggccccaaatctgtatgagctagacagtgacttgactaaggagccggatgtcatcataggagaaggtccaactgactctgagttttttcatcagaggtttcggaacctaatctatgtggaatttgttgggcctcggaagaccctgatcaaactccgaaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcgtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctggaagaagaagaagaagatgaagcagcagcagctgcagcagcagcagcccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaattttttttttttttggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcgccaacactttggaacctaatactgtgtaaggctttacaatatacggattggctttttgtgacccagattgattggttgccacatgttatgtttgttgaagtggttctcatgcaaaaatattacacatttgtgttctgggttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatgcagggagtgtcaaagtttaggaagattgtagagctgagagcaagaagcagaaatgagtgagtcaaagaagggagtcctaatatatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataa

SEQ ID NO: 975 - DNA, 3001 bp, Homo sapiens
aatcttataacttgaagaactgccctggagaaaggaagaaacttataataaatgggaaattataaatctagaccaacccaaacttgtactgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagtcacaatattcttctctatgaggatgggcatgctgtggtggcagattttggagaatcaagatttctacagtctctggatgaagacaacatgacaaaacaacctgggaacctccgttggatggctcctgaggtgttcacgcagtgcactcggtacaccatcaaagcagatgtcttcagctatgctctgtgtctgtgggaaattctcactggcgaaattccattcgctcatctcaagccagcggctgcggcagcagacatggcttaccaccacatcagacctcccattggctattccattcccaagcccatatcatctctgctgatacgagggtggaacgcatgtcctgaaggaagacccgaattttctgaagttgtcatgaagttagaagagtgtctctgcaacattgagctgatgtctcctgcatcaagtaacagcagtgggtctctctcaccttcttcttcttctgattgcctggtgaaccggggaggacctggccggagtcatgtggcagcattaagaagtcgtttcgaattggaatatgctctaaatgcaaggtcctatgctgctttgtcccaaagtgctggacaatattcctctcaaggtctgtctttggaggagatgaaaagaagtcttcaatacacacccattgacaaatatggctatgtatccgatcccatgagctcaatgcattttcattcttgccgaaatagtagcagctttgaggacagcagctgacagcattcggcgtatacctaaggagagttttttccccgaactgacagcaacgattccaaccacggcaagctggcttccaactataacattttactctcaaaggtctccttaaattgggcttgtttttacttgtcctatttaattccccactattagcaggctttggatttgtgcctaaggaataatatgcaaaagaaccaagacagaatgtatatgaagaattgtttttaattttgtaaattaaaaaaaaatttagatcgttacttggaaatggagcctaagtctgtggtggacagataataattatgttttcctgggctgaattatgtagacttgtgtttgacagctatgggtttatttcttagaacattgttcattttcttttctcattatgttacttctagtgttcacctctgtgattaaagattctttggtgaaatag

SEQ ID NO: 976 - DNA, 4164 bp, Homo sapiens
gagcggccgcgccccctgcgctgccaacccgcgagcccgcatcatggatgtcgagctcccctatttcgcattgctagccctggaattcgagaccccagacgaggaccaggattcatgaaatcagtcgcaggggccggggcaggggcctctggctcccgacactggccgagaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctgctggagacagtaacatctaccggaaacccccgatctacaaacggcatggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatacccccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatggggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaacctgtgtgcttctgttgtttcttgtgtgggagtggaaatgactgacatgggaagaggctgaaccctgcacatttttcaaaatgaaagcaccaaaacagcagcc

SEQ ID NO: 977 - DNA, 1967 bp, Homo sapiens
gttgcgcgccgtggcggcctctgtgcagtcgccggttccggaggagggcccaacccggctgggtgggtgggaagtgtggctggtaacctggcagccgcggagagagagaagattataaatggcagagccatttaactgtggttagctgttggattctgatactttcttaaaaatacgttcttgcaccaacatcttcattgggaacagttcagaaaaagcaaagaggagagccaacattcacatttaccatggctataccaataacagtgcttgactgtgacctcttgctatatggccgtggtcaccggacattggaccgttttaagctggatgatgtgactgatgaatacttgatgtccatgtatgggtttccacggcagttcatttattacttggtggagctcttgggggcgaatctttctaggcctactcagcgatccagggctattagcccagagacacaggtccttgcagcattgggtttttatacctcaggttccttccagactcggatgggagatgccattggaatcagtcaggcgtctatgagtcgttgtgttgccaatgtcactgaagcacttgtggaaagggcctcacagttcattcgctttccagctgatgaagcctccattcaggctctgaaggatgaattctatgggttggcagggatgccaggggtgatgggggtggttgactgtatccatgtggccatcaaggcaccaaatgctgaagacctctcctatgtgaaccgaaaaggcctgcattctttaaactgcctgatggtgtgtgacattagagggacactaatgaccgtggagacaaactggcccggcagcctacaggactgtgctgtgctgcagcagtcttccctcagtagtcagtttgaagcgggtatgcacaaagatagctggcttctgggtgacagttccttctttcttcgaacctggctcatgaccccacttcacattcctgaaactccagcagaatatcgctataacatggcccattctgcaactcacagtgtgattgagaagactttccgaaccctctgctcccgattccgctgcctggatggatccaagggggcactgcagtactcaccagagaaatccagccatatcatcttggcctgttgtgtcctccacaacatctccctggagcatgggatggatgtttggtcctctccaatgacaggacccatggaacagcccccggaagaggagtatgagcacatggagtccctggacttagaggctgaccgtattcgtcaggagctaatgctcactcattttagctaatgtagaaggtggagaggagggatacttcccaggagttgtgacagactttcctcctcatcaccttttacacagttccatcatctagcatgactgagtatacagatacttgtcataaactgacatttaatatgtgtgttttggtaaggttggggctatgccagaatatcttgattcatttgcatatgcattaattaaactgaaaccaagacagcggctccctactatccagtgaactctaggttgagtaccactaatttgaaagctcagtggttgcaaacatttatgactgtgcctacaaagtcatagtaaaggtcaggagttcaagacaagaccagcctggccaacatggtgaaaccccgtctctactaaaaatacaaaaattagcggccgggtgcggtggctcacgcctgtaatcccagcactttgggaggccgaggcgggcggatcacctgagttcaggagttaagaccagcctgggcaacatggcaagaccctgtctctactaaaaatacaaaaaaattagctgggcgtggtgacaggtgcctgtaatcccagctactcggtaggctgaggcaggagaatcacttgaaccagggaggcggaggttgtggtgagccgagatcgtgccattgcactccagcctaggcaagaagagcgaaactccgtctc

SEQ ID NO: 978 - DNA, 3972 bp, Homo sapiens
gcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccgtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctctatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 979 - DNA, 2651 bp, Homo sapiens
agtttctcctttgttttacgtttgggaggaggtggcattggaaatagcagagtgcttcgcggtaacaggggttggagtgcaatggtgtgatctcagctcactgcaacccctgcctcccaggctccagcgatcctcccacctcagcctcctgaatagctgaccaccagcacactaggcaaacccaccccactcacggcctcccttgggaattcagacctaaccatcgctgagctgaaacaaatgtactgaggctggagcctgtgtgaacagaacagaagaggccttcactctagtagtgctcacagtccagcaggtgtttgctgaagacagcttactcagatcactactgcctggaggtggttgatatatcctggtgtaaaccttcaagaagggcacaggcaggaaaacatgagccagcaactgaagaaacgggcaaagacaagacaccagaaaggcctgggtggaagagcccccagtggggctaagcccaggcaaggcaagtcaagccaagacctgcaggcggaaatagaacctgtcagcgcggtgtgggccttatgtgatggctatgtgtgctatgagcctggccctcaggctctcggaggggatgatttctcagactgttacatagaatgcgtcataaggggtgagttttctcaacccatcctggaagaggactcactttttgagtccttggaatacctaaagaaaggatcagaacaacagctttctcaaaaggttttcgaagcaagctcccttgaatgttctttggaatacatgaaaaaaggggtaaagaaagagcttccacaaaagatagttggagagaattcgcttgagtattctgagtacatgacaggcaagaagcttccgcctggaggaatacctggcattgacctatcagatcctaaacagctcgcagaatttgctagaaagaagccccccataaataaagaatatgacagtctgagcgcaatcgcttgtcctcagagtggatgcactaggaagttgaggaatagagctgccctgagaaagcatctcctcattcatggtccccgagaccacgtctgtgcggaatgtgggaaagcgttcgttgagagctcaaaactaaagagacatttcctggttcatactggagagaagccgtttcggtgcacttttgaagggtgcggaaagcgcttctctctggactttaatttgcgtacgcacgtgcgcatccacacgggggagaaacgtttcgtgtgtccctttcaaggctgcaacaggaggtttattcagtcaaataacctgaaagcccacatcctaacgcatgcaaatacgaacaagaatgaacaagagggaaagtagtcctccaacaggatgaagcagattaacagaagagtgatcagtgacaaacatgcctcattgattattgtttctaggaaggaatttctaaatcaatattgcaaccccaaaagcggttataatttggtgttactaagatgctcctacactttgtgataccgttttaaggacatggtgcatttttttttcttttatttgttttatttagaactttttttatttgttttatttagaactttgtgtgttcttaaagtgtgcttccaacaggaaggtcagtgataaattttcaaaagcataaccttcaatatattatctgttggattattggatataagacttattttcatgtactataaatatgaaaataactttgatttttaattgtgtagtttccatttcttagcttttgccttttaaatttatacttcagccaggcatagtgactgatgcctgtaatcccaacactttgttgggaggccaaagcaggaggatagcttgaggccaggagttccagaccagcctgggcaacatagtgagatcctgtctctacaaaaaaatttgtttttatttgtatttatatatttttatttttgtttttgttggtaggcgtctcgctctgtcacccaggctggagtctagtgtcgtgatcttggctcactgcaacctccacctcccgggttcaagtgattctctggcctcagcctcccaagtagctgggactacaggtgtgtgtcaccacgcccggctaatttttgtatttttagtagagatggggtttcaccatgttggccaggctagtctcaaactcctgacctccagtgatctgcccacctcggcctcccaaagtgctgggattacaggtgtgagccactgtgcctggccccccacaacatgtttaaacttagctaggcctggttgcatacgcctgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttcagaaa

SEQ ID NO: 980 - DNA, 1909 bp, Homo sapiens
gcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctccaaacgtg

SEQ ID NO: 981 - DNA, 2968 bp, Homo sapiens
ggcggtagcggcagcggcggcggcggcggcggcggcggcggcggcggcggcggcggcggcggcagcggcggcggcctgggcccgggcgcagcggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagccaacacggggattgtcaatcacacccactcccggatgggctccataatgagcacggggattgtccaagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgca

SEQ ID NO: 982 - DNA, 2985 bp, Homo sapiens
ggaaggcgctgggacggttacccagcgggccgccggcggtcgtgggcaagcttcgccatgcagagcactgacctaggcaacaaggagagcggcaagatatggcaccgcaagccgtccccggccacgcgggacggaattatagtgaacattattcacaacacttccgattaccatccaaaagttttgcgatttttgaatgtggcttttgatggcacaggcgactgcttaattgctggggaccaccaaggaaatatttatgtttttgacttacatggaaacaggttcaatcttgttcagcgaacagcacaagcttgcacagctctggcctttaatcttcgtaggaaatctgaattccttgtggcattagctgattattctattaaatgttttgatacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggttttctttctaccattaagtaataccatcctcagctgttttaaagataattccatttttgcctgggaatgtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataagccacctccgcctttagtgaaagttattgaagatttgcccaagaataaactgagttccagtgatcttaagatgaaagtaacatcagggagagtacagcagccagcaaaatctagggaaagcaaaatgcaaactagaatattaaaacaagacctgactggtgattttgaaagtaaaaagaatgaattaccagatggattaaacaaaaagcgtttacaaatcttattaaaaggctatggtgaatatccaacaaaatacagaatgttcatttggcgctctctgctacaactgcctgaaaatcatactgcgtttagtaccctcatagataaggggactcatgtggcatttctcaaccttcagaagaaataccccatcaaaagtaggaagctactcagagtattacagagaaccttatctgcattagctcactggtctgtcatttttagtgacacaccatatcttccactcttggcatttccatttgtaaaattattccagaacaaccaactcatctgttttgaagttattgctactctcataatcaattggtgtcaacactggtttgaatattttcctaatcctcctatcaatattcttagcatgatagaaaatgttttggcatttcatgacaaggaactgctgcaacacttcatagatcatgatataacctcccagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgagtttttttttcaccatcggaataacctggatataaatgttgtgattagacaagtttatcatctcatggagaccacgcctactgacattcatccagacagcatgcttaatgtttttgttgcactgacaaaagggcagtatccagtatttaatcaatatccaaagtttattgtggactatcaaacacaggaacgagaaagaataaggaatgatgaattggattacttaagagagaggcagacagttgaagatatgcaagctaaagtcgaccagcaaagagttgaagatgaagcttggtaccagaaacaggagctgcttcgtaaagctgaagaaacaagaagagaaatgctcttacaagaggaggagaaaatgatacaacaaagacagaggctagctgctgtgaaaagagagctgaaagtaaaggaaatgcacttacaagatgctgcaagaaggcgttttctgaagcttcagcaagatcaacaggaaatggaactaagaagactggatgatgaaattgggagaaagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcacctt

SEQ ID NO: 983 - DNA, 2790 bp, Homo sapiens
cggcggaggtgtctaccccgccggtgatggcgttgaacgccactggcttcccggccttccgtccgctgcctccgtccgattctgcgtctgcttgctgaggaggcggattaggggggcgcggagtctcttcccttgagtgcataggtcccggttggtagagggtttgagtccgcatcgccacagctgaaggctgcgagggactaagagcagaatatatctttagaaatgagttgcacaattgagaaggcacttgccgacgctaaagctcttgttgaaagattaagagatcatgacgatgcagcagaatctctgattgagcaaaccacagctctcaacaagcgagtagaagccatgaaacagtatcaggaagaaattcaagaacttaatgaagtcgcgagacatcggccacggtccacgttagttatgggaatccagcaagaaaacagacaaatcagagagttgcaacaagaaaacaaagaattacgtacatctctggaagaacatcagtcggccttggaacttataatgagcaagtaccgagaacaaatgtttagattgctaatggctagcaaaaaagatgatccgggtataataatgaagttaaaagagcagcactccaaggaactgcaagcacatgttgaccagataactgaaatggcagcagtaatgaggaaagccattgaaattgacgagcaacagggttgcaaggaacaagaacgaatatttcaacttgaacaagaaaacaaaggcttgagagagatccttcaaataactcgagaatcatttttgaacctaaggaaagatgatgcgtcggaaagtacttctttgtcagcattagtgaccaacagtgatttgagtctgaggaagagctgaagagtttctgagtctgtgagcttcttacatggctccaaatggtcaaataagtgaatgaatgaatggacagaaaattcaatcctttatttttttctctgtaaatatgtacagtgcacgggctatgagatagcaacaaaaaatgcatagttaatggtcatagactttattccaaaacataattggaaaatagaaactgagccattgccaaatggtaaagaaatgaaaagttttcacagtgactactgaatataccaagagcttttggcagtactgctggctttctgggtgattaattaggtaaacttgaatattcccagtaaatgtttgagaatgcataaaattataccaatttaaaaatataaatttttgccactgttttgtgaacggaggatttgtacgctaaatttcatccttatttggcgtcaaagttgatgcaaagtttatgtaccatgagacttctagtgattgcctactttcacatttatttaaatttttgtgaaagaaaatacagttttaaaggctataggaatgtgttatatgtaccttaaacagataatttaattttagcaatttatcataactgatacttagctaacaattgtccataacttgtttaagtgtaagaaataccatttcaggaatgaaaaagaaggaatactactttctaagaaagaagatcttataatagacatatttagtaggttaaactactcctttgaaagaataagttttggttcaaagtcaataatgaagacgagatttgtttttctcttctctggctgatttttaaggatattatgtagttcatttagttaacagaattgaaatgtttgatatggcaagataggtatggtaatttcaaagtgaattgggaattcctctggctcatagaacccttttttttttcctttaagtattcttgagatacaaaaaaaaaaagtaaatacaatttcaaaaaaaaagttccggatctgtttttaagctccatctggtcctcataacctgcaagatttttcttaaaacctttcagctgaaagtgggggtaaaggtggagtaatctgtggatttgtttctgttgtcttttaaaatgtcaaatatataatatgtaatttttttaaaaaccaccagatacagaaatgtgctttaacatcagttgaaacctaaattttcttatgttgtggtgattgtattaaaaagggataaaagaagagtgtcaaacatggttaaatatattgtactcatttatgttgaatacgtattaaaattaagacaaatggaaaattatactttgagtatataatttgttaaatattactttatatggtaattttatgtataatttcatatattggtaaaattcaaaactacacttgagaatttttttatcttaagtttggggtgaatggggtggatgagactgattgaatagaaaagggctaatggcccaaacattatatagatttctttttttcagtcagaggccttatttgatattttataaataaatgacagtttttatttttaaactttttattgtttttgggaaagtattccttaatttaatgacacattcattcagatacttcttatccctgctaataaaggaaatctatttcaagctacaccattgagattaagtctgaggcagttcattgaggcagctctactataaaagcttacttgataaataattatttttgtaaacaagttgggttaacttattcttcgtctttttgcttggatatgaatttaaggtcttcatgtttaaagacatttactttgttatttagtgacacatttccatcctattttttttttttttttggttgttgttaaacagaaccttaagtttatgtttgaggtatgtactgcataggaacctattttattattaaagatgaatgattaaaattggta

SEQ ID NO: 984 - DNA, 7720 bp, Homo sapiens
gacggttgcctggtattattagcaagcagcaaatatggcggtggcgcgcgtggacgcggctttgcctcccggagaaggatcagtggtcaattggtcaggacagggactacagaaattaggtccaaatttaccctgtgaagctgatattcacactttgattctggataaaaatcagattattaaattggaaaatctggagaaatgcaaacgattaatacagttatcagtagctaataatcggctggttcggatgatgggtgtggccaagctgacgttgcttcgtgtattaaatttgcctcataatagcattggctgtgtggaagggctaaaggaactagtacatctggaatggctgaatttggcaggaaataatcttaaggccatggaacagatcaatagctgcacagctctacagcatctcgatttatcagacaataatatatcccagataggtgatctatctaaattggtatccctgaaaaccctgcttttacatggaaacatcatcacctctcttagaatggcacctgcttacctacccagaagtcttgctatactttctttggcagaaaatgaaatccgagacttaaatgagatctcttttttggcatccttaactgaattggaacagttgtcgattatgaacaatccttgtgtgatggcaacaccatccatcccaggatttgactatcggccgtacatcgtcagctggtgcctaaacctcagagtcctagatggatatgtgatttctcagaaggaaagtttgaaagctgaatggctctatagtcaaggcaaggggagagcatatcggcctggccagcacatccagcttgtccaatatctggctacagtctgccccctcacttctacactaggtcttcaaactgcagaggatgccaaactagagaagattttgagcaaacagaggtttcaccagaggcagttgatgaaccaaagccaaaatgaagagttgtctcctcttgttcctgttgaaacaagggcatcccttattcctgagcattcaagccctgttcaagattgccagatatcccaggaaagtgaacccgtcattcaagtgaattcttgggttgggataaacagtaatgatgatcagttatttgcggttaagaataattttccagcctctgtacacactacgagatattctcgaaatgatctgcacctggaagacatacagacggatgaggacaagttaaactgtagtcttctctcttcagagtctacttttatgccagttgcatcaggactgtctccactatcacctacagttgagctgaggctgcagggcattaacttgggcctagaagatgatggtgttgcagatgaatctgtgaaagggctggaaagccaggtgttggataaggaagaggaacagcctttatgggctgcaaatgagaattctgttcaaatgatgagaagtgaaatcaatacagaggtaaatgagaaagctggactattaccttgtcctgagccaacaataatcagtgctatcttgaaggatgataaccacagtcttacattttttcctgagtcaactgagcagaaacaatcagacataaagaaaccagaaaatacacaaccagaaaataaagaaaccatatctcaagcaacttcagagaaacttcccatgattttaacccagagatctgttgctttgggacaagacaaagttgcccttcagaaattaaatgatgcagccaccaagcttcaggcctgttggcggggattttatgccaggaactacaaccctcaagccaaagatgtgcgttacgaaatccggctacgcagaatgcaagagcacattgtctgcttaactgatgaaataaggagattacgaaaagaaagagatgaagaacgtattaaaaaatttgtacaagaagaagctttcagattcctttggaaccagaaatggggtcttgccatattgcccaggccggtctcaaacttctgggctcaagcagtcttccctcctcagcctcccaaagtaaggtctctacaggtttggcaacagacagtggaccagcgtctaagttcctggcatactgatgttcctcctatatcaagtactcttgtgccatcgaaacatccattatttacccaaagccaggagtcctcttgtgatcaaaatgctgattggtttattgcttctgatgtagctcctcaagagaaatcattaccagaatttccagactctggttttcattcctctctaacagaacaagttcattcattgcagcattctttggattttgagaaaagttccacagaaggcagtgaaagctccataatggggaattccattgacacagtcagatatggcaaagaatcagatttaggggatgttagtgaagaacatggtgaatggaataaggaaagctcaaataacgagcaggacaatagtctgcttgaacagtatttaacttcagttcaacagctggaagatgctgatgagaggaccaattttgatacagagacaagagatagcaaacttcacattgcttgtttcccagtacagttagatacattgtctgacggtgcttctgtagatgagagtcatggcatatctcctcctttgcaaggtgaaattagccagacacaagagaattctaaattaaatgcagaagttcaggggcagcagccagaatgtgattctacatttcagctattgcatgttggtgttactgtgtagcatgtcttttgggaggcagatatccacttaacttttcttaaaaatactttcagttgcctttgcttttttttggagggaaatactccctacccctaattttgttactacttatatagaatttgtattcatgtcttatatttttcagattctagatattgagctgagttttcattttgattttgttagctttttacttagctgtaaggtaccaaactatttatattgaaagctatatgcactttatttcttaactgaattgcatcaacaatgttcctgtttctttcatgtactcatttactttcaaaaataagctagaatatattaaagaaaatagaaaaaattaccttaaatatataaataagagaattttggcccttctgtgtctgagaaaattaattatatagcaaggaatgaaatttgataaagcaaatataaatgagaaatatgaggattgtgaattattgaaatttgccagtctccctggtgtaaaatgtttttttaaagccttttttcctcctttcggagtcaaggaaagcctttctataagcaaattaaggaagaaaaggtaggattataagatttctcaatggggatgattaaattgtctcatggaaaacttcagttaatgtcatgcatcagttttaacatatgaagtaaagtgttctatccaggattaaagtcaagtttacttaggcaacacaagaatatttcacttagatatgaagaaaggaaacactagtctccattcacttgaaatactctcatggcaaatatttatcctctcattaagtgctttttcaccctataggtaagcatttttgtgccaacatgttgtcagaaattaatgtatgttcatctcctctgttcctgcttatttttacttatatatttcagcagaaggtccgtggccattcacttcaattttgacctctgtcccatagtgaagaacatttaaagtaatactactggtcgaatatgaatgactttttaggaactactttttgtctaacctgaaaaagttccacatttggaagacaatttaatgatggtgaagaaataataaacctcactttacttgttaaaagggatatatatatatatatatatgtctgcaacttcagggagaaataagattgtgtttgaatattgtaggtagatgcatttgtaattaaggataatatcgtttaacaacatgtatttggtttccctcaacttacagacatacagctatttaaaactatggcaatacttaagcatctctaaatttaggtgctaaatatctattattctgttgtagtcattaggtgcccttctctgaagttatgtaaaataaaagcatctgatccttcaaggataaagttgaggatcacatggtacgtggcatttgttgttattgttttttaaagagatggaggctggctctgttggtgcggtgccatgatcatagttcactataacctcgaactcctggctcaagtgatctcccacttcagcctcccgagtatctgggattataagcaagagccactgctcccagctcatggtatttgttgatagtcataacatttttcctgtatggtaagacgtatttttctcagtttataaatacgtagcactcaggttgagacgacttggattttattcttagaaatccagaatcccttgaaaaggaaatattttctgtttcttataaataaaagagtaatcttactttcagaaggattttccttagtgaaacatgtgtaacattgaatgcatgttaaataaaaatggaatttctaactttttttcaatagtgctaattatcttttctgaatgattttgaatgtcttcttaaatataccctatttttctattttaaagttaagtgcctcacttgctgtccatagttagacaaagaaaaaccaatttccactgcactagtaccaaaatactactttatacattagtttttcataaaagctgctggaatgtcatgattcagtattacctaaatagatttctgctaaaatcctctccctcctgtcttttttaagttatggaaaaacacaactaaattcatttgatcatcagcacttgttagcaggatttccttttttacctttgccttgtttctttagcccacaaatagtactcagcatactttcattaaaaatttggcacaatatgataattgttaatattctgttcttcgtctgtgttttatttaacttttactagtgtttagaagtgcaagaatattaaatagccccttccttaactgtacatattatcttgaatgtagataaaatgaaaatactgtaaattagagtgtaggaaaactggcatagagttaatatattttaatgggtttacattatactttaaaagtaatttatataattaaaatatttggttttaactctatgggctattctttggttggctgaagagggaatgggtctagtaaggtttggaaagttaagctttgaacatggtctttgtgtttttttcctaacaaggaaaggtttagttcagctgtgctattttagtacacatcagttctcttgatttatggaagattcagtttatcaattaagaattcctgcagaagcacagaatcataccatgtaagagttggaaggaagcttaagagatttctgttcgaatctctttgtttcaaagatgaaactaaagcacagcatgttaaatgacttgtctaagttatagctagttagtagtaaataaactgaaaacctatatgctactgtagtccaaaattttattatgtcctcttaatctttacatttagtgagtcagtaaggaaatctctgcatatttctcattctctttgaaagaggaaaaaaacttctaagagagctacaactctatcactcatgacagagttgcttgtagaaaataactaattccttcagaaccctgagtgaattttttctaagaaatgtgacttgattaaaatggtttcaaaagagcaatagtggaaattaaagttttagaaaagagacctggcgtggtggttgacaactgtaatcccagtgctttgggaggctgaggccagaggatcacttgaggccaggagttcaagaccagcctggacaacatagcaagacccccctctctacaaaaaaaatttttttctgaaaagaataagtacattttagagtccatttatttgacgacaggcagtatgacaggttgctgaggtatataaaattttctagagaaatgctgagtttgatgacattttatcttcagttttgtagaacagatgttaaaatgttaactctcctggtgtgcagaaagctgtaatcatgacagttgataatatgcaatttagtttgattttataggtttaattataaaaggcttcacaatatgcatgttttaggaaaatgttcatttatttagtcatataatcgtttgtatatatgtaaataactttattctggaataatgtgggtgccatcttgagcgtgtgtttttatctgttttggattattttttgtatacaaacaccataatactgtattttcctgttatctacttaagtctagttctactttttcccaataatttcaggaaaatacaagcttgagatattatactatctcccttggtattttttgtgtgcaaagtcttagaattggatttataacattgataataaaaatataaaacgtttttcctcgggagttaagatggtaaaaagaaaaaaatagaatgaatatgatcatttctccatcataaaggaaagaagagacttcattgtgtgtgtgttttttttttttttttcgagatagagtttcactgttgtcacccaggctggtctcagctcactgcaacctccacttcctgggtacaagcgattctcctgcctcagcttcctgtgtagctgggattacaggtgtgcaaccacaaggctcggctaatttttttgtatttttagtagagatggggtttcaccatgttggccaggctggtctcgaactcctgacctcaagtgatccacccacctcggcctcgcaaagtgctgagattacaggtgtgagccactgtgcccagccgagacttcattgtttaatgtatatttttattttttccaaacaccagctcgaatcagagtatatttttattttgccacatacctttaaaaggtatttattgtgtcataatgttttaaatgttaaatatatgataccctcattcatgaagtgaagcagaaagggtctgtaaggaacattctaaacatttttaatgatattgcttttactgatcaagcttgttgtgccatattaaaattaaaagtcaaataaacaaagcagtcctcacagccttggaaagaaatagataattgtcttcttaagatgaggtgctttttatctgtggatgaatggaaatcacactgaattttaattcttatttattttagtggatagcaggaatcactctgtagtagttgtgttcattttcttttctttttcttttcttttttttgagagagtctcgctctgtcaccaggctggagtgcagtggcgtgatctcggctcactgcaacctccatctcctgggttcaagtgattctcctgcctcatcctcccgagtagctaagactacaggcacacgccaccatgcccagctaatttttatatttttagtagagatggggtttcaccatgttggccaggatggtctcaatctcttgacctcgtgatccacccagtttggcctcccaaagtgctgggattacaggcgtgagccactacacctggccttgttcatcttctaattaaatatctttgaatgttttgtaataattttaatgttgacaataagagtttaaaaataatttgattttggactgtatttagatttctctttaattttgctgtagaaatagtaaatgatttaaagtggttatgatgtgttttatgaaggcttactattttatattgtacttatttaatttgtatttgagtctgtctaattttaaataaaaggtttatacatttg

SEQ ID NO: 985 - DNA, 1568 bp, Homo sapiens
ggtggagcccgcgatggccgaacctgcgtctgtcgcggctgaatctctcgcgggcagcagggcgcgcgctgcacgcacagtactaggtcaggtggtgctcccgggtgaggagctgctcctgccggaacaggaggacgcggaaggccctgggggtgcagtggagcgaccgttgagcctgaatgctagagcgtgctcgcgggtgcgcgttgtatgcggtccgggccttcggcgctgtggggaccgcctgctggtcaccaagtgcggccgcctccgtcacaaggagcccggcagtggcagcggcggcggtgtttactgggtggactctcagcagaagcggtatgttccagtaaaaggagaccatgtgattggcatagtgacagctaaatctggagatatattcaaagttgatgttggagggagtgagccagcttctttgtcttacttgtcatttgaaggtgcaactaaaagaaacagaccaaatgtgcaggttggagatctcatctatggccagtttgtggttgctaataaagacatggaaccagagatggtctgtattgacagctgtggacgagccaatggaatgggtgtcattggacaggatggtctgctttttaaagtgactctgggcttaattagaaagctattagctccagattgtgaaatcatacaggaagtgggaaaactctatccactggagatagtatttggaatgaatggaagaatatgggttaaggcaaaaaccatccagcagactttaattttggcaaacattttagaagcttgtgaacacatgacgtcagatcaaagaaaacagatcttctccagattggcagaaagttgatataggtggacttttttacaggtcagttgaggcaaaaaactatgggttttttcaggtgaacctcccccatttaaatactcagaagataaggtgtgaatgtatgtattattagagtccgaaagtatttttataagttactggttttcacccacgcttttgtgggagagaaaatcattgcaaaatcattttttttgttcggtacaataaagtttactaaaaaacagtattagggtttatttggagttaactcccttagtaattgctacagcttccataattaactggaggtcagcagtaaaataattttgtgattataacagtaagccaggttcaccagaggaaatgtggaatacctaagtataaagcagcaaagaaatgtcacctgtagtcccattattcagcgggtgagtatataacaacgaaatactttttcatttaccaagtattgtgttttgcatggattaactcctttattctaactgcagaagacacttatcctcataattgaaactgaggcacagaatttaacttggcctacattctctatattcatcaaattgaaattatagttattatagcttatatgccactttgtaatatacttttgtctacttcaaacagcatgatacatttcacaactttagtcacatatttcatgttacaggatatttttgagttttatcattatataaataacactatgaggatttctgaatccaaatctggc

SEQ ID NO: 986 - DNA, 3478 bp, Homo sapiens
aacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtcttcaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaa

SEQ ID NO: 987 - DNA, 1963 bp, Homo sapiens
gcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggaacgcgctcatgttcaacaacgagctcatggccgacgtgcacttcgtcgtggggcccccgggggcgaccaggacggtgcccgcccacaagtacgtcttggctgtcggcagctccgtcttctatgccatgttctacggagacctggcggaagtcaaatctgaaattcacattccagacgtggagcccgcagcctttctgatcctcttaaagtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttgaacacccggtccaggttgaacaagacaccttctacacggccagtgccgtcctggacggcagcgaactcagctactttgggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcct

SEQ ID NO: 988 - DNA, 3760 bp, Homo sapiens
atgcgcgccctggcggccctgagcgcgcccccgaacgagcggctccttccccgggaccccgcggctacccgggaccccgacgccgcgcggccggcgcgcaggagcgcagtggagaggctggcggcggatcgcgccaagtatgtgcggggtcggccggggactggccggggcgtcgcttccgagggcagcggcccgggggcgatcaagtgcccggggaacgaccctgggcccccggcccgcgccccggccccggtggcgcgcagggctattgcgcggaagccgttgagaccggactcgctgatcatctaccggcagaaatgcgaattcgtgcgaggatcgggcgccgacggccccagggcaagcctggtgaagaagctcttccaggggccgggtaaggacaaggcgccggtgccccggacgggagacgagggcaaggccgggaacccggagacggtcccgaccactcctggccccgcggcggaccccgcaatccccgagaccccagccccagccgcgcggtccgcggcgccctccagtgtcccggccgcgccccctgggccagagccgcgggtggtgaggcgtcgggggctgcagcgctcacagtcggacctcagctcccgctattccgctgccttggccgagtctgacaccttcttccagtactgcggcctggaccccgaggtggtggaggccctggggagggagaacttcaccgcggggtcggactgtgtgaccctcaaggtgcgcagcgtgagcgtcgccacctccggcagcggcttctcccggcacagcggcggcgacgacgaggggctgcaggaggaggagctgatagagcaggtgcccagcaccacttcggtcatcgagaggaacgcccgcatcatcaagtggctgtacacctgtaagaaggccaaggagacccccagccaggagcagagccggacccgaggaagcaaaccttcccgatgatgaagacttcttgaaggatttcatgggtgatttgggatcccaggaccatttggctagtgtgcctaggtgaccacatgattgctgttttaccaggaatgcagcatcccattgacaaaacaagtgctctgagaaggtttaaaatactacagagaatatgggaacacagaccttgaaatttagctgagttgtaacagctgaaactccaagaggtgtcttccttgtttgaggtgaaactagtgttgcttccagagggcagctggaaaccgtaaagctgtttggaaatctttttgactgacttgctgacaaagaggtactgtgatgcattttaacaatatctaagttgatttttttttaaatcaaggaaaataaaaaccaagcatgaatgctatggtatgtgccccttttgaccatcctgggctgattaacatcatttaaatcaaagtaatcataaaaaggcatattctacttcaattatgtggtcaaataagagtaaacacacacactcacacatgctgaccccaattgccagagcattactgcactataaattacggttaattcccaaattatactactgtttatcttatttaacaagtcagaaagcacttttaaaataacttgagggctacaaggtcattctattaatgtcattctccattcgggttgtaggcatgtggaagtacccattaaaagataagttagagtttaaatactgataaacaaaaccttttattgcaactggacagtttctggagagttagcggaagaatcttggagtttcctttggtcagatgaatacaacatttcacttttgcagcactatttagaatgtactccatggttctcttgttcccaacttccaaaaagaacagaaaactttggtttacacagaacacgggcatctgaggcaggacctcttccctgccctttgatctgactcacacctccacatatgacgtaatcaacccaaatttgacaccaattcactcttttctgcaaagggcatattttgaaacaagggacagcctgagggcggctataatgagaatgttcatgggggttactgggtccctaattctgaacttgcttatgacacccagagtgaatagattcagattcagaaccttctgagaaataacccaaagaaaatttgttacccagccaattcttcgaaagcttaatatcaaaatatatcttttcaagaagaaaatcgttagagagaagaatgtggaggggagagaaatgggtttctcattgatatgatattttgttaaccatttcattttgaattattcaagttttggttaatattgtattcttttttcgtaactattttaccgtgagagtaggtcattgggttacttagatatttatttttacacagttattagtcttcagatagttttattttacttcatatgattttagtttttgtcagtataattttaaatcatgtttttcttggtcatctctttgtgtatattgtgtaattggattttcattgactgcaagtggagtgtttgccactcaattcagtactcagtactatggtgacttgttttcaaataagtctcagatacacatttagggagcctttgctggccgaatatagactctgtcaggacagcaggtcccctgatctaagaattttccccaatggttgctctaaaaatgctgctattttgctgttcactgtattgcacttagttaaaaagaagataatgtgaaagatgagagcagttttttaaaggatcttttcatatacccaattcccttattttcagatgtcccatcaattttagatatgaaagctttaagtaaaagtgtgtatgcctttctactgtcagaacaggatggatgcagcctgggtcagatttatttaagataaaaatcatgcagactcatcattcatatcataggtgaaaaatgtaaaaaccaaatggtttccactaaagccaccaagatcttttagaaatgtttgcacctttggtggtggcacaggaaaagagaagaattcagctggagtgaattctagaagtagatatcagaaacggggcatgaagaacaggggaactgggtggcatcagactcctaaagaagtgagttaattttccttcccttccattcagattcatgccacagctccatatcttgagtatgtgtaagaggtgagttccttcttcagccaggggcggtggctcatgcctttaatcccaatgctttgggaggccaaggtgggaggatcacttgtgccttggggttcaaggttgcagtgaaccatgattgcaccactgcactccagcctgagtgacagagcaagaccctgtctctaaaaatatatataaaaagtaaaactaaagaacttcttgcctaaacctgaattaccgcaatttgctgagtgactttgagaaaaatcagactgtttagttcagtcgggatgaaaagcttgcgattgcttcccacaagaatgggcaatagtgacggctgcaaggtacttttatttgttcatgaaagaacgacaatttttcaaaatgtaattaaacataatagaatgttttaaactactgggcactgaaactggaagaaaaaggaggctttattgaacattcccctttttcagttggttcaaagttcagcactgtggttatcattggtgatgccagaaaacattagtagacttagacaattgctatggcagtttctaaacagagctttttctatacactatttgcaactggagtgcaatattgtatattctgtgttaaagaaataaagtatttttatcatttattaa

SEQ ID NO: 989 - DNA, 1374 bp, Homo sapiens
ggacagcttggagatagggcccggaattgcgggcgtcactctgctcctgcgacctagccaggcgtgagggagtgacagcagcgcattcgcgggacgagagcgatgagtgagaacgccgcaccaggtctgatctcagagctgaagctggctgtgccctggggccacatcgcagccaaagcctggggctccctgcagggccctccagttctctgcctgcacggctggctggacaatgccagctccttcgacagactcatccctcttctcccgcaagacttttattacgttgccatggatttcggaggtcatgggctctcgtcccattacagcccaggtgtcccatattacctccagacttttgtgagtgagatccgaagagttgtggcagccttgaaatggaatcgattctccattctgggccacagcttcggtggcgtcgtgggcggaatgtttttctgtaccttccccgagatggtggataaacttatcttgctggacacgccgctctttctcctggaatcagatgaaatggagaacttgctgacctacaagcggagagccatagagcacgtgctgcaggtagaggcctcccaggagccctcgcacgtgttcagcctgaagcagctgctgcagaggttactgaagagcaatagccacttgagtgaggagtgcggggagcttctcctgcaaagaggaaccacgaaggtggccacaggtctggttctgaacagagaccagaggctcgcctgggcagagaacagcattgacttcatcagcagggagctgtgtgcgcattccatcaggaagctgcaggcccatgtcctgttgatcaaagcagtccacggatattttgattcaagacagaattactctgagaaggagtccctgtcgttcatgatagacacgatgaaatccaccctcaaagagcagttccagtttgtggaagtcccaggcaatcactgtgtccacatgagcgaaccccagcacgtggccagtatcatcagctccttcttacagtgcacacacatgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagggggagacagagtctgggttccagggctgctttctcctggctaataataaatatccagccagctggaggaaggaagggcaggctgggcccacctagcctttccctgctgcccaactggatggaaaataaaaggttcttgtattctca

SEQ ID NO: 990 - DNA, 4311 bp, Homo sapiens
gctggaggctcagcgcgcaagcgtgcgcgtgatttggccctgaacggacgccgtagccaagaggttgggcggatgttgtgagccgggtcgctgcggccgaggctccggcccccaggaccactggctgcccatgagagatgaaggatggcatccaagggggccggcatgtctttctcccgcaagagctataggctgacctcagatgctgagaaatccagggtcacaggcattgtgcaggagaagctgctgaatgactacctgaaccgcatcttttcctcttctgaacatgcacccccagcagccaccagcaggaaacccctgaacttccagaacctgccagaacatttggaccagttgctacaggtggacaatgaggaggaggaaagccagggacaggttgaagggcggcttggcccatccactgtggtcctggaccacacaggcggctttgaggggcttctcctggtggatgatgacctgctgggggtgattggacacagcaactttggcaccatccgctctaccacatgcgtgtacaaagggaaatggctctacgaggtcctcatctcctcccaggggctcatgcagatcggctggtgcaccatcagctgccgcttcaaccaggaggagggggttggagatacacacaactcctatgcctatgatggcaaccgcgtgcgcaagtggaatgtgaccacaacgaattatggcaaggcgtgggcagcgggggacatcgtgagctgcctgattgacctggatgatggcactctgtccttctgcctgaacggtgtatcactgggcactgcctttgagaacctgtccaggggcctgggtatggcctacttcccagccatcagcctctctttcaaggagtccgtggccttcaactttggcagccgtcctctgcgctacccagtggcaggctaccggcccctgcaggacccaccgagtgctgacctggtgcgggcacagaggttgctgggctgcttccgggcagtgctgagtgtggagctggaccctgtggaggggcggctgttggacaaggagagctccaagtggcggttgcggggccagcccaccgtcctcctcacactggcccacatcttccatcactttgcaccgcttctgcgcaaggtgtatctggtggaggctgtgctcatgagcttcttgctgggcatcgtggagaagggcacacccacacaggcacagtccgtggtgcaccaggtcctggacctcttgtggctcttcatggaggactacgaggtacaagattgcctcaagcagttgatgatgtctctgcttcggctgtaccgattctcacccattgtcccagacctgggcctacagatccattacctgcggctcactatcgccatcctgaggcatgagaagtcccgcaagtttctgcttagcaatgtcctcttcgacgtgctccgctccgtcgtcttcttttacatcaagagccccctgcgtgtggaggaggccggcctgcaggagctcattcccaccacctggtggccccactgctccagtagggagggcaaagagagcacggagatgaaggaggagaccgcagaggagcggctgcggcggcgagcctacgaacggggctgtcagcggctcaggaagcgcatcgaagtggtggaagaactacaggtccagatcctgaagctgctgctggacaataaagatgacaatgggggtgaagcttctaggtatatcttcctgaccaagtttcgcaagtttctgcaggagaacgccagtggccgggggaacatgcccatgctctgcccccctgagtacatggtctgcttcttacaccggctgatctctgccctgcgctactattgggatgaatacaaggcttccaatcctcatgcttccttcagtgaggaggcctacatcccgccccaggtcttctataatggcaaggtggactactttgacctgcagcgcctggggggcctcctctcgcacctgcggaagaccctcaaagatgaccttgcttccaaagccaacattgtgatcgacccactggagctccagtcaaccgccatggatgacctagatgaggatgaggagccagccccagctatggcccagcgccccatgcaggccctggctgttggggggccactgcccctgccccggcccggctggctcagttctccaactttgggccgagccaaccgcttcctcagcacagcggctgtgagcctcatgaccccacggcggcctctgagcacctcggagaaagtgaaggtccgcacgctgagcgtggagcagaggacccgtgaggacattgaaggcagccactggaatgagggcttgctgctggggcggccccccgaggagcctgagcagcccctcaccgagaactcgctgctggaagtcctggatggggcggtcatgatgtacaacctcagcgtacaccagcagctgggcaagatggtgggtgtctccgatgatgtcaatgaatacgctatggctctgagggacacagaggacaagctccgccggtgccccaagaggaggaaggacatccttgcagagttgaccaagagccagaaggttttctcagaaaagctggaccacctgagccgccgtcttgcctgggtccatgccactgtctactcccaggagaagatgctggacatctactggctgctgcgcgtctgcctgcggaccattgagcacggtgatcgcacagggtctctctttgccttcatgcccgagttctacctgagcgtggccatcaacagctacagtgctctcaagaattactttggtcccgtgcacagcatggaggagctcccaggctatgaagagaccctgacccgcctggctgccattctcgccaaacactttgccgacgcacgcattgtgggcactgacatccgagactcactgatgcaggccctggccagctacgtgtgctacccacactccctgcgggctgtggagcgaatccccgaggagcagcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacagctgctaaaccaggtgctgaaccgggtgacagctgagaggaacctgtttgatcgtgtggtcaccctacggctgcctggcctagagagcgtggaccactatcccattctggtggcagtgacgggcatcctggtgcagctcctggtgcgtggcccagcctcagagagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaagcctgtatcaaccagcacctgatgaacaacaaggactgcttcttctgcaaaaccaccatcgtgtctgtagaggactgggagaagggagccaatacgagtactacctcctcagctgcctagccctcacagcctgtgccatcctggaacctccacctttgaacccagagccaggctgggccctatttatgagctccctttgcccttctcctgtatcccacaccaccacatccaacctccttgcctgcctgtatcctcattggtgggagcccagccatggccctaattgtgcctgagcttgactttcagtcagggccacagtgagcattaaattattattccata

SEQ ID NO: 991 - DNA, 3627 bp, Homo sapiens
gccgccgcgcggccggggcttctcactctgacgggcccgcgcgcacgatggccggcgccgcgccgcgggtccgctacctggcgggcttctgctgccctctcgggggcctggcggcgggcaagccccgcgtgctgtgccatgaggcagaggtcttcctgtccaccgggagcgagctcgtctacgtgtacgaccaggagggcgggctgctgaccgcggcgttccggttccccgaccaggtgtggcacctggagctgctggcgccgcgcaggttgctgtacgcgctgtgcgcccggaggggcctctactgcctgtcgctggaccacccgggcaggagcaggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccccgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgactgacctgtgcccagcagggcccatccaggccgtggagattcaagtggaaagctcctctctggccgacatttgcagggcgcaccatgccgttgtcgggcgcatgcagacgatggtgacagagcaggccacccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccagccggggcagtacccagcactgtgcactattttcagggccactcagggtggcgctgtggcccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttca

SEQ ID NO: 992 - DNA, 4024 bp, Homo sapiens
attatcctccttattgacaaacagagcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccgtaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaacatttatatacctcattctttagtgttgttaaatgaaaaattaaaatttgtgtttattataagatactttcaatggaataccagctaaccagatatgttcctttaaaacatgaatttttttgtcttattctgtttttaacatgtttcaaatgttttatacatttttggagatagtaaaaatttaaaaatgtaatagggaaaatatttaatttttaagtcaaaaactatgctttaaaggaattacatcttatgatcaaataactttcaggatgtattttaaatgagctgcaagagagaaaaatctgacaggagatgggattttacctgaatggagcatactcatatttctacataggtgggaagatactcatctttctacatagacgggaacacggtgtagcatggagattaagcgtgctaactgacacctcatgtttgaatcctgttgtagaatggaaatgagcttaaattacccaagcttactttccatctataaaacagggctaataatggtaatcacatctaatttatagggtttttgggaggattaagtcaatccgtgtaaaattcttaattatctgacacatactggtcactcagtaaatgtgagcttttaccattgttataggtaaaatcccattacaaaaatacaaaaatattttttgtaacagttattttcctgccctcttggatgacctaaagtaatagtgttttatagatttcactaaattttcagtgtaatatcagatgttttctctggatgcagaaagaccatctttccataattaaagaacctggtgggtgtgcactatgagattggagaaatgaattaagttgacttgaaattattttacttttattaatcacaggtatctcaacctgcctttgtttcaccctacttcaagtacacttccacaccaggaaaacagacccaaattccataaacagaactgacgttaaaatatgcgaaagattcagaacctaggtttagggtacatgtttttctctgtttcatgaacttacagtgtggtttgagcactgggttcttttagccaaattccatacaaaaagaatttggatgttttccagcatttattaccttactttgctataagtaagagtgaagataggccgggtgtgatggctcatgccagtaatcccagcactttgggctgaagcaggcagatattttgagcccaggaccagcctgggcaacatggtgaaagctcatctctatgaaaaaatttgaatatacatatatatatatatgtatatttaaaaagtgaatataatttgaggcacagaagaatattcttaaaaccttttgtattatacaatagaaataaaggttttatttttattaaatgctttcctaaaatgatagtggataatagacaaagtgaaaacatttaaaaaggaagagaaacttcagcctttctaagttgatagcatgtttattaacttttagataaagatccttatagactgaaagaatgtagcctctgcattaatggtaaatggtctagaagttttcgtttccactgaggcttccgccactcgcttttttaaacttcctgctatggtttggatatggtttgtcctcaccaaaactcatgctgaggcctgagtccccagtttgattgtgttggtaggtggtgcctttaagaggtgattaggtcattgagatggattaaaggctttctcatgaggctcagttagttctggaatggattcgctcttgcaggaatggatgaattctcacaagagtgggttgttatgaagtgaggatgcttcttgtgttctgttctctttgccctcctcagttcaccatctgctttccaccatgagttgaagcagcatgaggccctcatcagatgggctccctgatcttggactcctcagcctttggactcataagccaaaataaatctgttttctttataaa

SEQ ID NO: 993 - DNA, 3490 bp, Homo sapiens
cagagagagaaggtaaaccaagggaacatgccagggcttcagagcaccttcctagccatggacacggaggagggggtagaggtggtgtggaacgagctccacttcggagacaggaaggccttcgcggcgcacgaggagaagatccagaccgtgttcgagcagctggtgctggtggaccacccgaacatcgtgaagttgcacaagtactggctggatacctctgaggcctgcgcgagggtcatcttcatcacagagtacgtgtcatcaggcagcctcaagcaattcctcaaaaagaccaagaagaaccacaaggccatgaacgcccgggtatggggagcgggctggggcagccacggggacaggacggggttggggcagcctcggggactgggatggtgagggggtgcccggcggcctcggacaggggctgggcgaggatgcggggcgggctccgcaggcccagccgcctctcctgcgcccacccgaccgacggagtcgtgcgtccgccgccaggcctggaagcgctggtgcacgcagatcctgtctgcgctcagcttcctgcacgcctgcagccccccaatcatccacgggaacctgaccagcgacaccatcttcattcagcacaacggcctcatcaagatcggctccgtgtggcaccgaatcttctccaatgcacttccagatgatctccgaagccccatccgcgctgagcgagaggaacttcggaacctgcacttcttccccccagagtatggagaggtggccgatgggaccgctgtggacatcttctcctttgggatgtgtgcgctggagatggctgtactggaaatccagaccaatggggacacccgggtcacagaggaggccattgctcgcgccaggcactcgctgagtgaccccaacatgcgggagttcatcctttgctgcctggcccgggaccctgcccgccggccctctgcccacagcctcctcttccaccgcgtgctcttcgaggtgcactcgctgaagctcctggcagcccactgcttcatccagcaccagtacctcatgcctgagaatgtggtggaggagaagaccaaggccatggacctgcacgcggtcttggcggagcttccccggccccgcaggcccccgctgcagtggcggtactcggaagtctccttcatggagctggacaaattcctggaggatgtcaggaatggaatctacccactgatgaactttgcagccactcgacccctggggctgccccgtgtgctggccccacccccggaggaggtccaaaaggccaagaccccgacgccagagccctttgactctgagaccagaaaggtcatccagatgcagtgcaacctggagagaagcgaggacaaggcgcgctggcatctcactctgcttctggtgctggaagaccggctgcaccggcagctgacctacgacctgctcccaacggacagcgcccaggacctcgcctcggagctcgtgcactatggcttcctccacgaggacgaccggatgaagctggccgccttcctggagagcaccttcctcaagtaccgtgggacccaggcctgacccggagccccagccccaggggaccatgccggggtgctgcctgggcaggccatgttggggagactccagcaccgtggggctgccctcctccatgcgcctgggagcacaaaggccccggtagtgaaggaaccccccgtctcctgagagtggggctgaccctgccttgggcgccgaggggttggggggtgggtgtgggggagccgttaggcctcccaggtccttaggatcagggttgcccccagaaccccttcccatatcctccattctccgccctgagttcctacccaggctgcctggccggggccactgcctcctcagcatgcaggaggctgccctgtagggaaccccagctctggggcttgggggtgagggtcagccctggacagacctctgcccagggaactgctccatggggtctgggagagcagccatcccctgctggcaccatagacccacacaaggagcctgcacagcaagccagcggtgacacacctgcaggtgtcaggcatggcactgggcacaacagggacctggcaggagaaacagaccacagagaggtctggagttgaggctgttgtcagcaaagcccctggtcccacacagctctgccctagagccacctctttgaccctttacccaccctgagaccagaacttgcagcccctctgcagatctcctctggccactgcagcccctccaatgggctttttctctcatgcattccctggcctggaggcgtcagggaccccacatcctccctgctcctcagactcacagcccctccatgttacctcccgcacctcctccctggggcagctgctccctgggcctctgaggatgtcagctcctggctccctgcctctctcccactccactcctggctcagtcttagagatttctatgccctcatggattctacccctgccttcctggcctcttgattcttggcttgcctctcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaaccatttctctggttccctgcagacaggaaaggttgtccctaaggactcatgagattaggttgggcccagccagataatacatgataatctccctcctcaaggtttttaatattaaacacatctgcaggacacattttgccatgtaaactaacattcactggttccagggattaaggaatgaacctcttttgttggggaagggtggcattctgctgaccacagcactccaaccaaaagccaaaaaccaaagcaagacttactaacgcatatcaaataaattaaaggtacaaaatcgtgaatctcagttatcttaaatattccaatactatttacaaaattattcaaattctcacgccttccaactcaaaattagcaatctaaagtaatttccatatcctagatggaaaccctcatgctaaactgtctgattatgcatggttctaaatggtttcagtggcaaatacataacattgtactactgattaaactgaacttaaaagc

SEQ ID NO: 994 - DNA, 915 bp, Homo sapiens
gtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgatttgtgtacatcaatggcagaatcatccagcgaatcagatcacttccgctgtcgtgaccgattgagtccatgggctgccagatcaacgcacaggggaactcgaagtcttcctacagtagaagttaccgagaaggtcaacactataacaagtactttacaggataccagtcggaacctgcgacaagtggaccagatgcttggacgataccgagaatacagtaatggacaggcgggtgcgatagaacatttaaaagaaagcttggaacaatcaatcgaccaactccggagtcaacgtttattgagaaactcaggagggagaagtatttctgttacaagtttgagtgcaagtgaccttgatggtggcactgggtcagagctccatcattttccacctacctcacctctcaaggactatggggatccacagggtattaaacgaatgagatcaagaactggtgtccggtttgttcaagagactgatgatatgactcagcttcatggttttcatcagtctcttcgagacctcagcagtgaacaaattcgccttggagatgatttcaacagggagctttccagaaggagccggtcagatgccgaaacaaaaagggctttggaagaattgactgaaaaacttaatgaagcccagaaacaagaagtgttttttgtgaagagccttggaaaggtgaagatacaatgcctgtcttctgctgaagtagacaacgtctttccaattaatgtgtggcaatgtggtatctaa

SEQ ID NO: 995 - DNA, 1700 bp, Homo sapiens
gtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagtaaggatgagtctgccttcatggtccacccgctgacggcacagggagtggccgtggtaatagtggcttacggcatcgcccccaaaggcaccctggaccacatggtagaccaggtgacccgcagcgttgcgtttgtccagaagcggtatccaagcaacaagggaatttacctgtgtggacactcagccggggcccacctggctgccatgatgctcctggccgactggaccaagcatggggtcacgcccaacctcagaggctttttcctggtgagtggggtctttgacctggagcccatcgtgtatacttcacagaacgttgctctccagctgaccctggaggacgctcagaggaatagcccccagctgaaggtggcccaggcacagccggtggaccccacctgccgtgtgctggtggtcgtgggccagttcgactcccccgaattccaccgacagtcctgggagttttaccaggtactcccagtgcagaccctgtgtcaaggagagtggaaagcctcatttgaagagctccacgatgtggaccactttgaaattgttgagaatctgacccagaaggacaacgtgctcacccagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcccggagctgcctcttagactcgtctggcccatctacctgctgacagagcatgacaaagatgacgctcaaaagtaatgccattacttcttttttttttttttttttttttttttttgagatggagtcttactctgtcacccaggctggagtgcagtggcgtgatcttggctcactgcaacctccacctcccgggttcaagcaattctcctgcctcagcctcctgagcagctgggactacaggcgcctgccatcatgcctggctaatttttgtatttttagtagagacggggtttcaacatattggccaggctggtctcaaactcctaaccttgtgattcgcccgccttggcctcccaaagtgctgggattccaggcgtgagccactgcgcccggccagaatggcattatatttaaatagttcataaagaagcacaaaagaatattatttcataacatgtaaaaattatataaaacgtaaatttccatgttgataaataaagttgtattggaacacg

SEQ ID NO: 996 - DNA, 1461 bp, Homo sapiens
atgtcaggttccactccatttcagatgagattagttcatttagaccttaaaggagctccaccaaaggtctcgtacctctcagagatttttcctctgttccgtgcgctaggtgcaaacggcctcctcattgagtatgaagacatgtttccctacgagggccctctgaggctgctgagggccaagtacgcctacagcccctctgaaatcaaagagatcttgcatctggctggactcaatgagctggaggtgattcccttggtgcagacatttggacacatggagtttgtgctgaagcacacggccttcgcccacctgcgggaggtgggctccttcccctgcaccctgaacccccacgaggcagagtccctggcgctggtgggcgccatgattgaccaggtcctggagctacacccaggcgcccagcggctgcacatcgggtgtgatgaggtctattacctcggagagggggaggcctcgcgccggtggctacagcaagagcagaacagcacggggaagttgtgcctgtcacacatgcgggcggtggccagcggcgtgaaggcccggcgccccagcgtgacacccctggtgtgggacgacatgctccgagacctgcctgaggaccagctcgcagcgtccggggtgccgcagctggtggagccggtgctctgggactacacggccgacctggatgtgcacggcaaggtcctcctcatgcagaagtaccggcggtgcggctttccgcagctgtgggcagccagtgccttcaagggtgccacggggcccagccaggccgtgccccctgttgagcaccacctcaggaaccacgtgcagtggctgcaggtggcgggcagcgggcccacggactcactgcagggcatcatcctgaccggctggcagaggtacgaccactactctgtgctgtgcgagctgctgcccgcaggagtcccgtccctggccgcctgcctgcagttgcttctacgcggaggatttgatgaagatgttaaagcgaaagtggagaaccttctcgggatttccagcctggaaaaaacggaccctgttagggagggggccggctccttccctggcagcaacatccttgcccttgtcacacaagtcagcctccatctgcgcagctctgtggatgcgctgctggagggcaacaggtatgtcactggctggttcagcccctaccaccgccagcggaagctcatccacccggtcatggttcagcacatccagcccgcagcgctcagcctcctggcacagtggagcaccctcgtgcaggagctggaggctgccctgcagctggctttctacccggatgccgtggaggagtggctggaggaaaacgtgcaccccagcctgcagcggctgcaagctctgctgcaggacctcagcgaggtgtctgcccccccgctgccacccaccagccctggcagggacgttgctcaggacccctga

SEQ ID NO: 997 - DNA, 733 bp, Homo sapiens
ctctcctggggtccagcttgtcgcctctggctcacctgttcctagagcaatgtcttcccagcagcagcagcggcagcagcagcagtgcccaccccagagggcccagcagcagcaagtgaagcagccttgtcagccaccccctgttaaatgtcaagagacatgtgcacccaaaaccaaggatccatgtgctccccaggtcaagaagcaatgcccaccgaaaggcaccatcattccagcccagcagaagtgtccctcagcccagcaagcctccaagagcaaacagaagtaaggatggactggatattaccatcatccaccatcctggctaccagatggaaccttctcttcttccttctcctcttccctccagctcttgagcctaccctcctctcacatctcctcctgcccaagatgtaaggaagcattgtaaggatttcttcccatcgtacccttccccacacataccaccttggcttcttctatatcccaccccgatgctctcccaggtgggtgtgagagagacctcattctctgcaggctccagcgtggccacagctaaggcccatccatttcccaaagtgaggaaagtgtctgggcttcttctggggttccaccctgacaagtagggtcacagaggctggtgcacagtttctgcctcattcctctccatgatgccccctgctctgggcttctctcctgttttccccaataaatatgtgcctcatgtaataaa

SEQ ID NO: 998 - DNA, 3120 bp, Homo sapiens
gctttttctcctccgcacagaagtcgcgctcgggcagcctgcgcgctcgcagcaggaaccaggctccaggcgccggcgccggggccggggccgcggggaggaggcgacttcgctccctgcggcgggcgcggcccgggcgcccgagcctcctcggccttggagagcagcggcggcggcggcaccccgggcgcggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcggggactcaagggcaaaaaactgtatcctgtagtgagtgccgtctggggccactgtgagatccgaatgcgctacttgaacggactcgatcccgagccgctgccgctcatggatttgtgccgtcgctcggtgcgcctggccctggggagggagcgcctgggggagatccacacgctgccgctgccggcttccctcaaggcctacctcctctaccagtgacgttcgccatcataccgccagcgcgacagccacctggtgccaactcactgagccgcctgccgctggggccgccgcaccctgcaccttggaccggcatccgtagccatggacagaggtccctggtcttccctcatcctccgtggctgcctccatgggacaaggaccgattccaacacaggctcctctttcccccttcccgacatcagcagaaggcagcatccctgcatgccgtccgtatacaacccctctttgaaaaaagacacagagaataaactcctacgaaagccctacattgagctccaatctgctcggggtgggacgggtgcttcccacacctctgggagaaggctgcagccacctgggggtcccagggtggtgggggtggcaggtggtaccacagctctgagagcagataccaggggtactaagaggtgcttagacaagggctggtgcccggcccagggtgcccagcggggccatgccatggcagataaagctcaggacgtcaaaaactcaccatggaccccaaggcagaaaccaagaactgtctgcaggcaaataagcacccagcacccatcctggctgccggtgccccgtaccctgtatttattcttttaacaataacaaaagccatttatttattccatctagaaaggaaaccctgtttcagtcccctctctctggctgttctgttactttccttccacctgtgccctccctgggatatgtatgcctcgcccgccctccctgggcacatgtgcacacgtgcccaggcacaagtatgtctctgggtcccttgccctgcagtttccagggggctctgctccaagttccctagcgggcccctcagggagaaatagcctcacgtgcaatctgggtgtcttcgggggcccgtctggaagggctgcagcaattcccctgtgtctccaggtaaccagctaactcttgggctcaggcacccttgcacagggttgcatttctttagtcttctgtgggtcttttgatgtgggtttgattttgcttttgcttttctagctgagatttcccaagtgcatcctcagaagctctgggtgtgccagaggacccccagaactaagaagggagggcgagtgggtctccattccccgagaagccgggggcagggtgggatggggaagaccaggagcagagtcgagcctcacagaagccagcgcgggtctctgctcagcaccccagccggggctctggacccagggtaacagccccagttcatcccaacccctctcagagcctcaagaggggtagctcggctgccggaagagaggggtgccctatccctggcaacccctccacgtagcgtaccccagcacctgccaccgcctttgccatttctttgagcttgaagttaactctcttagagtctaactttggttcatttctgcacaggtacaatagatgactttatttgtttaaaatgtttaatatatatacatacatatatatatatttgtctgtaagaattatgttttaaacagctgctgtagagtacctttttttaagtaaatcttacagtggagtatattttttaaagcacaaaattggtgccaagactgggtgagaaatgtacattacccccttattattttgacggttttttttttcggggcaggggaccttacctgtaagacttttaaagattttcctccctcctgtttcaggtgggtcacattctgatgaatgtttcccttgtacagatcccagcttatggccttgacccagccgtcctcacagatgccgggtgaccctctagctctctctgcatctcccaccccccgacaccctgggaccctcgaccccacccttctttcctaccagcccagagccttgtggcttgtacagttttgaaactcccgttctattttatgatggttgataatagtcagtaacctaataaaggaacgtttgttaaaatatcaaa

SEQ ID NO: 999 - DNA, 3859 bp, Homo sapiens
cggacggggccgccccgatgggacgccgcgctccggcccctgcgcgccgctgagccgagcgccccccgctgccgagacccccgccgccaccgccagccgctgccccctcgcccccgcccgggccgggagcctcgtccccgtcccccggaaagctggatttccgaggctggaggcgcctggccggctgggtggggaccaccatgggcaacgcggccggcagcgccgagcagcccgcgggccccgccgcgccgccccccaagcagcccgcgcctcccaagcagccgatgcccgcggccggagagctggaggagaggttcaaccgcgccctgaactgcatgaacttgcccccagacaaggtccagctgctgagccagtatgacaacgagaagaagtgggagctcatctgtgatcaggagcggtttcaagtcaagaatccccccgcagcctacatccagaagctgaagagctatgtggatactggtggggtcagccgaaaggtagcagctgattggatgtccaacctggggtttaagaggcgagttcaggagtccacgcaggtgctacgggagctggagacctccctgaggaccaaccacattgggtgggtgcaggagttcctcaatgaagagaaccgtggcctggatgtgctgctcgagtacctggcctttgcccagtgctctgtcacgtatgacatggagagcacagacaacggggcttccaactcagagaaaaacaagcccctggagcagtctgtggaagacctcagcaagggtccaccctcctccgtgcccaaaagccgccacctgaccatcaagctgaccccagcccacagcaggaaggccctgcggaattcccgcatcgtcagccagaaggacgacgtccacgtctgtattatgtgcctacgcgccatcatgaactaccagtctggcttcagccttgtcatgaaccacccagcctgtgtcaatgagattgctctgagcctcaacaacaagaaccccagaaccaaggctctggtgctggagctgctggcggccgtgtgcttggtgcggggaggacatgacatcatccttgcagcctttgacaacttcaaggaggtgtgtggggagcagcaccgctttgaaaagctgatggaatatttccggaatgaggacagcaacatcgacttcatggtggcctgcatgcagttcatcaacattgtggtacattcggtggagaacatgaacttccgtgtcttcctgcaatatgagttcacccacttgggcctggacctgtacttggagaggcttcggctcaccgagagtgacaagctgcaggtgcagatccaggcgtacctggacaatatttttgatgtgggggcgctgctggaggacacagagaccaagaacgctgtgctggagcacatggaggaactgcaggagcaagtggcgctgctgacagagcggcttcgggacgcggagaacgaatccatggccaagattgcagaactggaaaaacagctaagccaggcgcgcaaggagttggagaccctgcgggagcgcttcagcgaatcgaccgccatggggccctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccagatctcgcacctgcagcagagccggctcccggagcagcgccaccgccgccgcccccactgcccggcctcccctccccgcaggaagccccgccctctgcgcccccacaggccccgcctctccctggcagcccggagcccccgcctgcgccgccgctgcccggagacctgccgcccccacccccgccaccgccaccacctccgggcactgacgggccggtgcctccgccgccgccgccgccgccgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgc

SEQ ID NO: 1000 - DNA, 743 bp, Homo sapiens
gggtccgttggggcagaaccatggaggaaaagccttcgaaagtgtcgctcaagtcttccgaccgccaaggctcggacgaggagagcgtgcatagcgacactcgggacctgtggaccacgaccacgctgtcccaggcacagctgaacatgccgctgtccgaggtctgcgagggcttcgacgaggagggccgcaacattagcaagacccgcgggtggcacagcccggggcggggctcgttggacgaggggtacaaggccagccacaagccggaggaactggacgagcacgcgctggtggagctggagttgcaccgcggcagctccatggaaatcaatctgggggagaaggacactgcatcccagatcgaggccgaaaagtcttcctcaatgtcatcactcaatattgcgaagcacatgccccatcgagcctactgggcagagcagcagagcaggctgccactgcccctgatggaactcatggagaatgaagctctggaaatcctcaccaaagccctccggagctaccagttagggatcggcagggaccacttcctgactaaggagctgcagcgatacatcgaagggctcaagaagcgccggagcaagaggctgtacgtgaattaaaaacgccaccttgggctcgagcagcgacccgaaccagccccgtgccagcccggtccccagacccaagcctgaccccatccgagtggaatttgagtcctaaagaaataaaagagtcgatgc

SEQ ID NO: 1001 - DNA, 5157 bp, Homo sapiens
gcatcatggaatgatataaaaatgcagctttccaatcacactaagggtctctctatttcttctcttgaccaccaatcaggaacctttgctggaagcttgtttctgattggtgaaagtaagccataacagtggaatgccaaggagtaaatacaaaagtgtagcaacaactgagtttgctgtctcactaccctcagcctaggccaacctggactccttcaccccaaatgaggtgaccgctacattttatatgaagacactgatttaccattcaactgtgatccatcttataacatggcaatccaatacagacaggaagataaaactcaacaacagctaaaataaagtgtattcccaggtaaaatagacaagtgctttaatttgaaatggattcgtccgatgagtgtcagttacaagggcagagaaggtaccagtgcagaagagctctgactgtgggcagtgtcaccaggtcccactaagtggcaacacttgtgctgggtgacttgacccatcttgatgtataaacccatagccagacaggacgtgcaaacaggtctcatggtgaatgcgatgctgtggaaaatgacatggagaatggctgtctctcagctagggaggagggtcttggtgtcctagtaaagaatgttcacgtcctggagttggtggttggtgttctatctaggcgatgagagaaggatgcttttcctaatgagcacctggtgggaatagagtctctctttgcacttcgctggaggaagaaatttctaccacttattttttcttcttgcttatagaatacacattgcagaaaaaggatgaagttgaccagtgaaaagttgcccaagaaccccttttatgcctctgtatctcagtatgctgctaaaaaccaaaaatttttccagtggaaaaaggaaaagactgattacacccatgctaatttggtggataaggcattgcagctcttgaaggaaagaatactgaaaggagacactctggcatatttcctacgaggtcaactatattttgaagagggatggtatgaagaagcattagaacagtttgaagaaatcaaggagaaagaccatcaagcaacttaccagctaggagtgatgtactatgatgggctggggaccactctagacgctgagaaaggggtggactatatgaagaaaattcttgattctccatgtcccaaagcaagacacttaaaatttgcagctgcttacaacctcggaagagcttattatgaaggaaaaggtgttaaacgatcaaatgaggaagctgaaagactgtggcttatcgcagcagacaatggaaatcccaaagctagtgtgaaggctcaaagtatgctcgggctgtattactcaaccaaggagcccaaggagttagaaaaggcattttactggcattccgaagcatgtggcaatgggaatctggagtcccagggtgcacttgggctcatgtacttgtatggacaaggcatccggcaggatacggaagctgccctgcagtgcttaagagaagcagcagaacgcggaaacgtctatgctcaagggaatctcgtggagtattactataagatgaaattttttacaaagtgtgttgcattttccaaaaggatcgctgactatgatgaggttcacgacatccccatgatcgcccaggtcacagactgtctcccggagttcatcggcagaggcatggcaatggcatccttctaccacgcaaggtgtcttcagcttggcttgggcatcaccagggatgaaacaaccgctaaacactattattctaaagcttgtcgtctgaatcccgcattggcagatgaacttcactccttacttattcgtcaaagaatttagaccacaatgtatttcaacaaagatcatcaatgctaacacctcacaatgtgtgtatttttacagtagctatgtttggttattttgcacatcacaaattacactatcctgggtattttacaggtgacatgttacttcgttcttgaattcgtacgctgttaagttttgcaacttgaaacctagacacaaggtcaaattgctggaagagtcctcagaggtccacctcttaccctacagactggccgagaccatatcaagtattaaaaccattctatacagcaagtatcgtttatcctttcttaaacaccgagtctccaaaaatacttagtttagctttagtttagtaagttcagaagtagaaacaaacttatttaaaaccatcatttgaaagtttaattctttaaatttgtctcttagttttgtgaattttgaataataatgtttaaattttgtttcagtcatttaaaatttaaattttcagtcatttaaaattttaaaaatttaaaatttcacaaaactaagggtaaaagacatttaaagaattaaacttaaataagtgtgtgcagcatttctacttctgaagttattaaagctaaaactgcactaagccttttgagacatcctttattcttaaaaagctcataaataattggcttattacatataaacttcaaaaaagtgggttataagacattgctttagaatcttgcccctccaaatcttccctcaaagatcttaatgagtaaaacaactgctacatacatatgcagaatgtgtaataaaacaaaaagcaattgctatatgaaaatattcgtaagaaaagtaaagcaaattgtttctttgtgcttcagctcattttccatatttttaaaaccctgtggtaaaagcctcaatgaaatcatttacaagaactacaattaaatattgttaaaattagcaaaaggctttccgtatatagatgacatctatgaaggcaaaaggtgacagtaaaaacagtaagatccatatgcataagattgtacaaggctattcatttgtgaaacaaatatacatatcgaagacaggtctcagagataccttaactattcctttttttataaacatattaaaggatgtggctttattttataaatcacaaccatcccaacagtggatttaaacaagatttctttttagtaatgggaaaatgcaattaatatggaggtgatagtcactaagaactgttgaatggcagaaaagtatttgctctcgttttatgttctggcttgtctgtattgcctgaacttcattttgtctttgtgtaagggaagaaatttcaacagactcgggtttgagatatcctcaaatggtcatgtatttctgtctcaaatctcttaataccacccatgtaacattccttcaaccacttgaagatccaaattcccaactagtattctcttctccacacttaatccagttcctaaagattattattattattattattattatttttttttttttgagacggagtctcctgacctaatcttagcccggcgcagtggctcacgtctgtaatcccagcactttgggaggctgaggcgggcagatcatgaggtcaggagtttgagaccaggctggccaacgtggtgaaaccccgtctctactaaaaatacaaaaattagccgggcgtgatggcggacgcctgtagtcccagctactcgggaggctgagacagaagaactgcttgaaaccaggaggcagaggttgcagtgagctgagatcgcgcaaattgcactccagcctcggtgacaagagcgagactccatctcaaaaaaaaataaaaagaatcttaaaataggaacataataaaagatcggccctaagtaaagagcactttttaaactgccattaaagatgggtttcagaaatcataaactttgacgtgtgccatacatggtaacatgctatgcttatatgtcttctataaatccaatgcagaatttaaaatttcagtttactctagttaccataaagctaatgctctggcacaagcgagtccctgcaaactaccactgctgaggacagtagtaaaccccttgacctgagactgcggtgagtctgtaactcgagtgcattgagacttccagatcattactcttacacacacacacacacacacacatacacacacacacactccttctctaagattccttgtagctgatatctcatggaaaaatgacattttatcataaataaatatagagacaaaataatagtgatctttctcattcgcaatgtaaacttaacagctacagtttaaatgatagcatagaattatgcctaaaatagacatttcccataattgtattgtgataagttcttcaggcttgacaacttcacattgcctctcttccttgaatgtattttatctggtcttttctatatagtcttttgaaggataatttttatcaatagccaactttgggtatttttttaagtgtcaaatatcatcatggtttgaaaaaaggataaaaaagctataactaaaaaaatcttaaggataacatttggtttactaatttttaatcatttatctttcagaacttgtttcttatcaagaagttagcaggtatgatatgtatatcatacgtatataaactggcataggttacatcctagggcatgaggggagtatctttcagggattcaaatggaatttttacctgttacttgtttaattgttttgttttcaatattcttggggattagacaggggaaggtattttattactgcataatagatggtgaaacccaggaaaattaagtacttgtgcatggccccactatcaataacacaaagtctgtactctggatctcccctaatgtccctgtggtctaaacggcttgataatacaaccgagcccctgaagtagctgccctcctctttccgctcccccatctcggccctgcccatactccaagggtcagctcccatctctcctccctaatgcctcacttcaagcactaatttggctctttctgctcactaaaaatcatatattttacagatttattttgtttctggagaaggcagcaaacttttacttccctgcagaagtagttaagtacatagtgttttctctaaaaaggcatttgataaatatttgaacagcctgtagagtttcaacctctttgagatataagtatcttaaatatcatagagcactgtgattcatttttatattttattgctttgaatgctcaaactatgggaaatctttggtaaaaataaagacaataaaatcttcacaataacttt

SEQ ID NO: 1002 - DNA, 6089 bp, Homo sapiens
cagcgctggcgtcaatgctcccttcctcgggccattggagactccgttgctttttaatggcggcagcggctgctgggtgagcagctggaggccggacagtgttcgtcccatccggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtatcagtattatctgcaactgaagaaagatatcttggaaggaagtattccttgtaccttagaacaagcaattcagctagcaggcttagctgttcaagcggattttggtgactttgatcagtatgaatcccaggactttcttcagaaatttgccttgtttcctgtgggatggttacaagatgaaaaagtattggaagaagcaacccaaaaagtggccttactacatcagaaatacagagggctcacagctcctgatgctgaaatgctgtacatgcaggaggtagagagaatggatggctatggagaagagagctaccctgctaaggatagccaaggaagtgacatatccattggagcgtgtcttgaaggtatctttgtgaaacacaagaatggaaggcatcctgtggtatttaggtggcatgacattgccaacatgtcccacaacaagtccttttttgcattagagctggcaaataaagaggagaccattcaatttcaaactgaagacatggaaacagcaaaatacatttggagactctgtgttgcgcgacacaagttttacagactaaaccagtgtaacctgcaaactcagactgtcacagtgaacccaatcaggaggaggtcttcttcaaggatgtctctgcctaaaccccagccctacgtgatgcctcccccaccgcagttgcactataatggacattatacagaaccatatgcttcttcccaagataacctctttgtgcccaaccagaacggatactactgtcactctcagacaagcttggatagagcccagattgacctcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccactcggtgcaaacgttccaggaggacagcctgcccgtggcgcactcgctgcaggaggtcagcgagcccctcaccgccgcgcgccacgcgcagctgcacaaacggaacagcatcgaggtggccgggctcagccacggcctggagggcctgcggctcaaggagcgcaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgcctcctgcacgtgcgcgcgagcctcggcccggcctggcccaggacccacctggctgccctcgcgtcctgctcgccgggcccctgcacatcctggagcccaaggcccacgtcccagacgcggagaagaggatgatggacagcagccccgtccgcacgaccgcagaggcccagcggccctggagagacgggctgctgatgccctccatgtcggagtccgacctcaccacgtcaggccgctaccgagcccggagggactctctgaagaaaaggccggtgtcggaccttctctctgggaagaagaacatcgtggaagggctcccgcctctagggggaatgaaaaagactcgagtagatgcaaaaaaaattggtcctcttaaactggctgccctaaatggactctccctatctcgagtgcctctgcctgatgaaggaaaggaagtggctaccagagcaacgaatgatgaaaggtgtaaaattctggaacaacgattagaacaaggaatggtattcacagaatatgaaagaattcttaagaaacggctagttgatggggagtgctcaacagcacgactccctgaaaatgcagaaagaaatcgattccaagatgttcttccttatgatgatgtgagagtggagttggtcccaactaaagaaaacaacactggttacatcaacgcatcacatattaaggtctctgtcagtggaatcgaatgggattatattgccacacagggaccattacagaatacctgtcaagatttttggcagatggtatgggaacagggaattgcaattatagcaatggtgacagcagaagaggagggtggaagggagaagagctttaggtactggccacgacttggttccaggcacaacactgtcacctatggaaggtttaagatcacgacccggttccgcacagactctggctgctatgccaccacaggcctgaagatgaagcacctccttactgggcaagagaggaccgtctggcacctccaatacacagactggcctgaacatggctgtccagaagacctcaagggatttttatcatatcttgaagagatccagtctgttcgacgccatacaaatagcacaagtgatccccaaagccccaaccctccgttgttggtccactgcagtgctggggtaggaaggactggcgtggtgattttgtcggagatcatgatcgcctgcctggaacacaatgaggtgctggacatcccgagagtgctggacatgctgaggcaacagagaatgatgctggtgcagactctctgccagtacacatttgtgtacagagtcctcatccagttcctgaaaagctccaggctcatctaagctcccacaatttcttacggggccagtcatgtgaagcgtttacagcttaaaaaaaaagcgcttgcctaactcatactttcccgttgacacttgatccacgcagcgtggcactgggacgtaagtggcgcagtctgaatggcggcacgctgaaggaaacgtgcgaagcacaggctgaagaggggtttctaacctgggaaaggtgctcaaggaggacttggtttcaagggccttgccctgccccggtctgtccggtttgcagtacttgcacacattttggagattgtattttctagacaattctctattttactgaagctatgctgggcaattctggcaatcattaaagtgcatagatttctatcttaaactaatttttgataatggagtttttattttatgacaaatatttagggatttttctagtgagaaacaactttgtgtaaggatgatccacagatatgagttgctcctatataactttgtatttaaaaatcatgttattatcttttgttattttttaaaaaccttgggtacttaataatggtttagttgccaaactgaaaactatactgagaatctgtgttattttgaaacatcaaaaggatttttctatccagaacattttttatcctaaaaattctatatagttgtaccttctgtttttcaaatgagagctcaattcatttagatactgaaatgagtcagttaatgtaaagttgaggatgaaggcacattatttaaaatgtaagagaataagcattattttttcagtattattcatagatctaaatgaatttgattttattggttgaaaatgaagtgaaaaacaattgcctagggtggttttaagcacttttttgttaaaaacaaatctgagttttaatatatgtgttgctttgtagatgacacaataacaatgggcgctgagaagcgttttgggagagattaaggactaagagtatgtaagatgactaggacaagagtaggtggagtgtgatggtaaatgcaggatgccttcgtctttacaaaaatgcagtattatctatactcagactgaggtgctgggatggcgagcaggggaccccacagcactgtccccagggaattcaagtcctgtgaccgccagtgacttactccgtttccttggggcttttcccacctcaacctgtattgtttctttttcataaataaattcagcattatagtatcattaaaagaagccttaaagaggcgtatttttccttttggttgaaggaagggaatagttaataatagttttcacctcttctcccaaaaagtacagtccaaatttgtgcacagagattgctgtggtattcaagaggtacttgcattttagctccttaataattccctggccagtgttagctgtttagtgccccctcacccatcccatttaggcacatcccaatagacagagccaggctgagttacagggggagagtgtcatctctggccccgattaagatggccttgtcacagtgaccgctgagtaggcatggatgagtgggatatttagctgaggaaccctttcccttttccttctttttggggtctcttcttacagtgaacttccaaaatgtcaaatctagggctgtttcccaaattacactattctaggcatcattttgattcccatgtcactccttaactcacttccttgagcactacatgtatgttgtcagccacgagacaggacttcctaaatagtgtgtgcaccagcctaactctgccttacccagaaaccaaccacctaagaggaaaactcagaagatattaatgaaaactaattgaaagtacgcacacttctcatgtaggaacaaaattaaaattttacatttttattttacaaaattaaaaaattacattttgtaggaacaaaatgtaaattttgtaaatacaaaattctttttaaagtcctgtttaaagaacagtagaactaagtgaaaatattcagaacgagctccttagaagaaaggaataagaactttttactggaactattttccatctctagaaaaagtgcttcttcccctccccctccctctccatggtacgtttttgtgaaaatgcttttctgtcaggtttaaacaaacagtttgacatagctcgttgacaagaacatattgtaaaacaaatctaattaaagagtaatatgtggtctatttgtgttcctgttgtaataatttgataagtaaacttctgagggcaaaattactgtttaatattactcttaaaatgttgcatgtttggcgtcattcctaagagccatgtaattttaaacttttaattgcagttagtgaatatgaaaggatttctgaataaaaatctatccacatta

SEQ ID NO: 1003 - DNA, 2815 bp, Homo sapiens
cacgccggcgctccaggcgcggcaggctgccgcccccggaagtagtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagataaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaattttgagtcaattctacccctgacatttggccaaaagcttacttaaaattaaggatttactaagtcatcatcagctgtttttcttaatttcagccagactattaattttgagccattatgtaatatatgccataggcaattaaaacataattttatcagaa

SEQ ID NO: 1004 - DNA, 876 bp, Homo sapiens
ggcagcctcacgctcggctccagcggccaagagccggagaaagtcctgctggtgggcggccgcggggctgagggcgtccggcatcccggggccgctccggcccgggcggcgagagtgcccggcggtccatgcatccgccgccgcccgccgccgcgatggatttcagtcagaacagcctgttcggttacatggaggacctgcaggagctcaccatcatcgagaggccggtccgccggagcctcaagacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagagtccatgaggatgcacacttatttatccagagagtatggatctcacatatgtttgtccagagggtgtgactctgtggaggagaacacttactgtggacagtcccagatgttgaagtcagcacaacaagagaaaaacccaaatcctgataagacttgaggatttttcgaaaattaaatgcaaaatagttggggcaaatgttgctgcgggagtcaagactaagtaatacagtaagaagatatgaagttggagagcttctcatgttcttcctttgtataaagtttgcatacgtacaaaacccaggactttaatgactttaagagggggcagaattgcatctcttggaagttaacagactcatgtgaactggaatgtacgttgtggccctcacaattgattttaatatttatttgcaaagtcctttctgtttctaaataaaagctgtgccttctgaaa

SEQ ID NO: 1005 - DNA, 1790 bp, Homo sapiens
atggaaacaagagtcttcccctcccacatgggaggaaaattcagtttcagctcagctagggatttagtcttactaaagacgcgggaggaagttctccagcgagcagctttccccaacgtggaaaggaccacgcaaggacacctgagctttccaacagatgttcagcgccaggggatccacaggtgggtgcacctgtgtggaagtaaagctgttgcttattctgggagccgaatccgaggcggagggaggtgggcgcggggctatttaaacgttggcggagggcgggctgggtcgctgcgcgtctgctcctccttctcacgtttctcctgccgtcctaatcccgccttggccatgagggagatcgtgctcacgcagatcgggcagtgcgggaatcagatcggcgccaagttctgggaggtgatctctgatgaacatgccatcgactccgctggcacctaccacggggacagccacctgcagctggagcgcatcaacgtgtactacaacgaggccagcggtggcaggtacgtgccccgcgctgtgctcgtggatctggagccgggcaccatggactctgtgcgctcggggcccttcgggcaggtcttcaggccagacaacttcatcttcggtcagtgtggggccggaaacaactgggccaagggacactacaccgaaggcgcggagctgatggagtcagtgatggacgttgtcagaaaggaggctgagagctgtgactgcctgcagggtttccagctgacccactccctgggtggggggactgggtctgggatgggtacccttctgctcagtaagatccgggaggagtacccagacaggatcataaacacattcagcatcctgccctcgcccaaggtgtcggacaccgtggtggagccctacaacgccaccctctcagtccaccagctcatagaaaacgcagatgagaccttttgcatagataacgaagctctgtatgacatatgttccaagaccctaaaactgcccacacccacctatggtgacctgaaccacctggtgtctgctaccatgagtggggtcaccacgtgcctgcgcttcccgggccagctgaatgctgacctgcggaagctggccgtgaacatggtcccgtttccccggctgcatttcttcatgcccggctttgccccactgaccagccggggcagccagcagtaccgggccttgactgtggctgagcttacccagcagatgtttgatgctaagaacatgatggctgcctgtgacccccgtcacggccgctacctaacggcggctgccattttcaggggtcgcatgcccatgagggaggtggatgaacaaatgttcaacattcaagataagaacagcagttactttgctgactggctccccaacaacgtaaaaacagccgtctgtgacatcccaccccgggggctaaaaatgtcagccaccttcattgggaataatacggccatccaggaactcttcaagcgtgtctcagagcagtttacagcaatgttcaggcgcaaggccttcctccactggtacacgggcgagggcatggatgagatggaattcaccgaggccgagagcaacatgaacgacctggtgtctgaatatcagcaatatcaggatgccacggccgaggaggaggaggatgaggagtatgccgaggaggaggtggcctagaactctccttttctaggtaaaggggggaagcagtgtggattctttactgtgttctgacagccatgtgtcactatacgcttgttaatttgtgtcttcacatctcc

SEQ ID NO: 1006 - DNA, 915 bp, Homo sapiens
atggcgaagattgagaaaaacgctcccacgatggaaaaaaagccagaactgtttaacatcatggaagtagatggagtccctacgttgatattatcaaaagaatggtgggaaaaagtatgtaatttccaagccaagcctgatgatcttattctggcaacttacccaaagtcaggtacaacatggatgcatgaaattttagacatgattctaaatgatggtgatgtggagaaatgcaaaagagcccagactctagatagacacgctttccttgaactgaaatttccccataaagaaaaaccagatttggagttcgttcttgaaatgtcctcaccacaactgataaaaacacatctcccttcacatctgattccaccatctatctggaaagaaaactgcaagattgtctatgtggccagaaatcccaaggattgcctggtgtcctactaccactttcacaggatggcttcctttatgcctgatcctcagaacttagaggaattttatgagaaattcatgtccggaaaagttgttggcgggtcctggtttgaccatgtgaaaggatggtgggctgcaaaagacatgcaccggatcctctacctcttctacgaggatattaaaaaagacccaaagcgggaaattgagaagatactgaagttcctggaaaaagacatatcagaggaaattctgaataaaatcatctatcacacctcctttgatgtaatgaagcaaaacccaatgaccaactataccactttgcccaccagcattatggaccactccatctccccttttatgaggaaagggatgcctggagactggaagaactattttactgtggcccaaaatgaagaatttgacaaggactaccagaagaagatggcaggaagcaccctaaccttccgcacagagatctga

SEQ ID NO: 1007 - DNA, 500 bp, Homo sapiens
caaggacaacctccacaaccaacaccatgtgtggcagctactacggaaactactatggcacccctggctatgggttctgtggctatggaggcctgggctatggctatggaggcctgggctgtggctatggctcctgctgtggctgtggcttccgcagactgggctgtggctatggctatggctcccgctccctctgtggctatggctatggatgcggctctggctctggctactattattgaggatgccatgggagactctcaccctctatcctgtgatactgagattcactaattctgaagcccacatgttctgagattttcccttgagtgatgatatcctgcaatggaagtctaatatggtctgttgttgagctaccatctaacctacaaatatcttgaatttccatcatgaaacgggataaggtaaaattcacctgtcagttctcctttcatcagaatgatggtgtcacatcatctgccttgatgacttttatgatg

SEQ ID NO: 1008 - DNA, 3087 bp, Homo sapiens
tgccagtcatcccaatggctattttgttttgcagaccacggtgtgaacacatgaacagaagacgaaaatttcttctagcctcagtacttgctctccagaattcaagttttatatatccatcatgtcagaagtgcttctctaggataatcctggtctccaaaagaattttgaaaaccaacctggacaaggttcagatgccagtaacttcttacagcaatgctctgaccacaaaagaaaagccaaagcactagtggcttgccagattgttctaccagacccaggtattgcaggctttactgtcattgactacttccatcaacttttgcagacttttaatttcaggaaacttcagtgtgactctcaggcacctaacaatcacttacttgctttagatcactcaaatagtgatctcagcagcatatatacttctgacagcacttctgattttttcaagtcctgcagcaaggatactttttcaaaattctggcagccatcacttgaattcacttgcattgtttcacaactaacagataatgatgatttttcagcttcagaacaaagtaaggcctttggtactcttcagcagaacagaaagtccatctccattgcagaggccactggttccagtagctgccatgatcccattcaggattcatggagccttgtttcatatatggataaaaagagtacagcagaaaagttgggtaaagaacttggcttacaagctaaggagctgagtgcagttcacagcagtcatcatgaaattggagttaatgactctaatttattctctttggaaatgcgagagccccttgagtcaagtaatacaaaatccttccacagtgcagtggaaattaaaaataggtcccagcatgagctaccatgttttcagcatcatggtatagataccccaactagccttcagaagagatctgcatgttgtccaccttcgttactcagacttgaagagacagccagcagttcccaggatggtgaccctcaaatttgggatgatctgccattctctgaaagcctgaacaagtttctggcagttcttgaaagtgagattgctgtaacccaggcagatgtcagtagtaggaaacatcatgtagataatgacattgataaatttcatgcagaccacagcaggttatctgtgactccccagagaactactggagccctgcatacaccacctatagctttaagatcatcacaagtaatagtcaaagcaaactgtagcaaagatgacttccttttcaactgtaaaggaaatctaagtcctagtgttgaaaaggagtcacaaccagataacaaagtagaggctgtctctgtaaatcataatggaagagatatgtcagaatattttttaccgaatccttacctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttgacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggcagaaagtcacccttcagagtctgatttttcactgagatcactttctgaagacttcatccagccttcacaaaaattatccttgcaaagcctatctgactctaggcattcaagaacatgctctccaacacctcattttcaatcagattcagaatataattttgaaaatagtcaagactttgttccatgttcacagtcaactccaatttcagggttccaccaaacaagaattcatgggataaacagagctttcaaaaaacctgtattttattcagatcttgatggtaactatgaaaaaataaggattttccctgaaaatgacaaacagcaagccagcccaagctgtccaaaaaatataaaaacacctagccagaaaatcagaagccctattgtatctggtgtttcacaaccagacgttttcaatcactacccttttgctgagtgccatgaaactgatagtgatgaatgggtccctcctaccacacaaaaaatatttccttcagatatgcttggattccaaggcataggtctagggaaatgccttgctgcctatcatttccctgatcaacaagagttaccaagaaagaaactgaaacatattagacaaggaaccaataaaggtttaattaagaagaaattaaagaatatgcttgcagcagttgttacgaaaaagaaaactcataaatataactgtaaaagttcaggctggatttccaaatgtccagacattcaagtcttagcagcacctcagctgcaccctattcttggacctgattcttgttcagaagtcaaatgttgccttccattttcagaaaaaggcccaccttcagtgtgtgaaactcgaagtgcttggtcacctgaattgttttcataaaaagtcacctgaacccaattcctgaacttttaaatctgtttggaaatgtttgccttcaggggtacggaaagcattctttacattttgaacacttggagagaagcaaattgaaaacaggactctgctgggagctactgtgccttttaaaatataaagccattgttttccccagggttttatctagaatactatgattaggtagttgagcactttatcttatactgtttattgtactttaataatattgttaagattgtttttgaaagtattaatgtttgttaaaatcacatatacatccagaaataaagactttgcaaacc

SEQ ID NO: 1009 - DNA, 491 bp, Homo sapiens
caagttccttctgctccatcttagggctgtttttactctgtcctcagccctccttctaacacccccacatagagaccttaattcaaactaaggtaagaaatgattgtctttatttcctgaaggctttttgaaagcaaagatgagcaacactcaagctgagaggtccataataggcatgatcgacatgtttcacaaatacaccggacgtgatggcaagattgagaagccaagcctgctgacgatgatgaaggagaacttccccaatttcctcagtgcctgtgacaaaaagggcatacattacctcgccactgtctttgagaaaaaggacaagaatgaggataagaagattgatttttctgagtttctgtccttgctgggagacatagccgcagactaccacaagcagagccatggagcggcgccctgttctgggggaagccagtgatccagccccaccaaggggcctccagagaccccaggaacaataagtg

SEQ ID NO: 1010 - DNA, 4089 bp, Homo sapiens
tgtccggaagtcctgagagggaaacgcccgcaaaggctggtttttaagcgggagcatctcttcactcgcagcaagtgcgcgtgcgctgcctctcagcccaaattggaaacatggccgtacggtcgctgtgggcgggccggctgcgggtgcagcgcctactggcctggagtgccgcgtgggagagcaagggatggccgcttccattcagcactgccacccagagaactgctggtgaggactgccgttctgaggaccctcctgatgagcttgggccccctcttgctgaacgagccttaagggtaaaagctgttaaactggagaaagaagtccaagatttaacagtgagataccagagagctatagctgattgtgaaaacataaggaggcgaacccagagatgtgtggaagacgccaagatatttggaatccagagtttctgtaaggacttggtggaggtggctgacattttggagaagactacagagtgcatttctgaagaatcggagcctgaggaccaaaagctcactctggagaaggtcttccgagggttgttgcttttagaagcaaagctgaaaagtgtgtttgccaagcatggcctggagaaactgacacccattggtgacaaatatgacccccatgagcatgaactcatctgtcatgtgccagctggtgttggggtgcagcctggcaccgtggcattagtaagacaagatggctacaaacttcatggccgcaccattaggcttgcccgagtggaagtggcagtggagtctcagagaagactgtgaagaggccatcaggaactggatgttctcccagagcgcagtcacctatgtttcttttatttattaaactaggtttgtattgtacatgaggtacttcatgtgatatgttttggatttagtcatattggctttatttctaagatattctattgatttaatgtgacctgtttggtctcatcagaagtcttaccattgggcatttgaacagtgtgacaggtgttccaatggcctttatcaaaacatgtttaggaaaattggtactgtgataaatttgaatccaaaatccttttaactatgggttttcaactacatgtttcttcctagcggtctctataacaggaattgtgtagtatcttgtattttgtggaaaaaggagatggtagggattggttcaacatttgggtacttagaggataaagcttcgtggtcgtataaatttagatcatttggattgatttttatacacatagattttcaggactttaccttttgttttgtttttttccttttagccatcttttgttcttgtaatcccaactagataggctttatgctcacatcattgtcccatacccacccctttctcatccccatttgcaggggctaaaggtctagatgagacttggaaggcaaggagcatcgaaatttgagatacccaggaccctttcaagcaagaatggccaaaaagccttgtgctgtctttgctcttcaaattattttcagcctccttgtcatataatcatttcaggcaaactgaggcaacactaacagctaatgacccagatggctctatttgggtaatttacctacaacttattccaccagcctttactcctctgcccttttgtcaattttaccttataatcctttattaaatgatgggaggtggtgatcaggacaaaagtgttaggttcccatgatttctcatttcatttattaatagttaatgctgaatttttttttaagtttcctctggctctatttatgttactttttgcgataagaacacttaacataagtattctctcctcttggcaattttttttttttttcctgtgttgcccaggctgacctccaactcctgggcccaagcaatcctgcctcagcctgccaagtagctaggactacaggcgttcaccactgcgcccgcaaagtttttttgttgtttttttttttaagttggtactcacaaatcactacctctgttatattgacaagctctatttcctattctttgtatctgttaagtcacatctgtgtaaacattgagctcaccttttatatattaacctctagaattaatgggcctatgtggttttttttcagtcttatagctggtgttctgtaaaagatttgtccaataaacgacttaatgaatgatacatcagtcagattttaggaaggcagtcaattatggatattttaatgttggaagaggccttaatgatcaaatctcaccctttctgcttctgaagtatgaaaatctagtctttttaggactggacacaaggaaaataatctctaaactattgactaaattccagtgagagtatgaatgaagaacaactagatattaatgtcaatcatttaagattaatgggcatgcaattaagtctccatttaagattaatgggcatgcaatgaagtctccagcagacaatcagatgttgttggatgtctagattatataggtttaggttgaagttataaaataaaataaaattcattttccactggaactctatgacattcagtggagtggtggaaagttaacctcttatacattatagataattctaagacagcacacaaacttatcaataaagccatctccttgtgggccttaccatcttcatcagatttagacccttaaaaaacaagtaaatatgcacttttaaaatgcaatcaaaagactggtggttaagcttgtaaaaccagaacatcttttggcattccactaagtatatattgtaaatttaatgaacaatcaaggttcacaataggaagttgtctttttttgccttccattctgtgagatttgacagatggtgacaataagaaaatgagctgattgtaattactctctgtgtgtttttttattgctagctatcattaccagttagaattaacattaattacaattaacaataattttaggtatggaatgttatgattacctaaagagatgtctctacctaatgagctcaagtgatcctcccacctcagcctaccaagtagccaggaccacaggcaagtgcaccaccatgactggctagttttgttttttggtttttggtttttggtttttggttttttttttttggttggttggttgttttttacaggcggggtctcactatattgtccaggctagaagaattttctaatggtctattacacctcccgttttggcaagtaaattcagaataattttaggttcttttgttattcagtagttttgcagacttaaaagtgtaaatttagaattagaagatgaagctatagtagtaagaatctcaagctgaagggctttggggagccaaagcagcatattagagcataggcttgaacttaaatctcagctcagtcacctgcaggactttaggcaccagtgatttcacccttctgagcctgtttctttattcgtaaaatgattataataattctttcacagcgttgtgaggattaagtgaaatgtgttaaatgcctactacagtaggtgctcagatatttatttttatttttttattatgcacattgtttttcctgcctttttatggctgtctaaagtctagggaaaagggaagactggttaatgatgagtagaaaaaacttgtaagctaatcattcactgacttattttccttccattttctggtttttaaaattagccacaccacaggaaacccacatttttagatggaaagagcaagaaaattgtgtcagtgctcttagttattttcatcttaatggtatagtgaaaagacattgacttgagatgatactaaggaagctttggctcactctcacttgaagaggggatcttggtgttgtagtacttggactgtacaaatgttttactgacttttcttactgctgtaaaggaatcaggcagttgggtattgatatgttatttggtgctctcattcatggcaaaggatttgataaataaaagttctttaaacactaaagcaaaatcaaatgagcaaaactaaggatgaaatgtaatattcatcagaacaaggatcactgagaaaaaatattcagaaacaactttaataaaacctgaattgaaataactgca

SEQ ID NO: 1011 - DNA, 2300 bp, Homo sapiens
ttgtttaacagctggcccggaagtttaagtgaatatgcggcttgggctccaaaagttgctgtacggtattttattttaaagtagaaatctgtccgcttttcacttacggaggccttacagtgtgtgttctgtgttacttgagtttatacgcactgcagaatttgtttaccctgctcttttggaaacgtattccggaagcgaaaccctgagtaatcggaagtggttaggagtgagagagctgctggatatgcggagggactgggcgggtcggcttccgaatggaagaggtctgtgagaagttaacctggtgataccgatccgaagagcctatcaagtgaagccccctgaaatacggagaataagaatcttagaggttgttcagcagaagtcttggagtgcattttcagtggttaaggtgaaaaaatgactactaaaaatttagaaaccaaagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaaatcgtgagttaaaaaagttactggtggcttctgttggggatgatcttcagtatcactttgaacgtctagcccgtgagaaaaatcagcttattttagaaaatgaagccctaggtcgaaacacagctcagctttctgaacagttagaacgtatgtcaatacagtgtgatgtatggcgaagtaaattccttgcaagcagggtaatggcagatgagttaaccaactcaagagcagctttacagcgtcaaaaccgtgatgcacacggggctatacaagatctcctaagtgaacgggaacagtttcgtcaagaaatgatagctacccagaaattattggaggagctcttagtttccttgcaatggggaagagagcaaacttactcccctagtgtacaaccccacagcacagcagagctagcattaacaaatcacaagttggcaaaagcagtaaattctcatcttctgggaaatgttggcattaacaatcaaaaaaagattccatcaacagttgaattctgcagcaccccagctgagaaaatggctgaaacggttctaagaattttagatccagttacctgcaaagagagttcacctgataatccattttttgagtcttcaccaaccaccttacttgctacaaagaaaaatattggacgatttcatccctatactagatatgaaaatataactttcaattgctgcaatcactgccggggagaactgattgccctttaacagtcaatatgttggaggcatgctaagaataaacaactaaataactgtattagaaaaaaaagaaacttactaaatatcataatctgatgatatgtggtcctgaattggctactagtttaagcaaataaactgtaagtcatttatgggttagttggggaataaatggatatgggctggatattcggtaatatcattaatgaaaagcagattgcagaaatacagtatgatctcagtattttgaaattgtaaatacatgtacagacaaatacttagacagtatgcatactggtgttaacagtcacaatttctgggtgatgaaaatgtaacttgaaaccgctccatttctacaatgcacatttactgtttctgttataataaaagggtatgttagaaaaacaaaaaggaggctgggcatggtggctcatgcctctaatctcagcactttgggaggccaaggtgggcggatcacttgaggtctggagtttgagaccagcctgagcaacatggtgagaccccatctctacaaaaaaaatataaaaattagccaggtgtggtggtgcacacctgtggtcccagctacttgggaggctgaggtgggaaaatcacttgaacctgggagggtgaggttgcagtgagctgagatcatgccactgcactccagcctgggtgacagg

SEQ ID NO: 1012 - DNA, 2138 bp, Homo sapiens
gctgccgctactgcggagtagctgcttcccttcctcctctcccggcggcggcggcggcagcggcggaggaggaggaggaggggacccgggcgcagagagccggccggcggcgcagttgcagcgcggagcccacgggccgccggggccgctccagcgggcggaagccgagcccggggccgaccccccgcgcgcggcggaggccgagggggcgccggggcccggggcgcgcagccggggggcgggcggcggcgggcggcgggccgagcgggagccgcatgcgtgtatggatccgggcgccgcgctgcagaggcgggccgggggcggcggcggtctgggcgcgggctccccggcgctgtcgggcggccagggccgccggaggaagcagccccccaggccggccgacttcaagttgcaggtcatcattatcggctcccgcggcgtgggcaagaccagcctgatggagcgcttcaccgacgacaccttctgcgaggcctgcaagtccaccgtgggtgttgacttcaaaatcaaaactgtagagctaagaggaaagaaaattagattacagatctgggacacagcaggtcaggagagattcaacagcattacctcagcttattacagaagtgccaaggggatcatattagtatatgatatcactaagaaggagacatttgatgatttgccgaaatggatgaagatgattgataagtatgcttcagaagatgcagagcttctcttagttggaaataagttggactgtgaaacggacagagaaatcaccaggcagcagggggaaaagtttgcacagcagatcactgggatgcggttctgtgaagcaagtgccaaggataacttcaatgtggacgagatatttttgaaacttgtcgatgacattctgaaaaagatgcctctggatattttaaggaatgagttgtccaatagtatcctgtcgttacaaccagagcctgagataccgccagaactgcctccaccaagaccacatgtccgatgctgttgatttcctactttggagacaaagtggaaatgattcctggaaaggggaaaaaacgttctattctgcactacaatcattttgacaatttcctttcgcactttgtaatccaagtcagagctatacactaacttgtaaatatgcatatatgcaatcctgggtaagttttggttataagttacctatttccctccaaattattatatttcattcattaccccagtgtctagtgtacatacactgggaaacctagtacttctaatatgaagaatgggagaaatgaaaggtataatgtttcttgaaataaataatataattgtccttattaattatattatgaggacagaagatattctgataagagagaacgtggtgctttgcttaccgttttaaagaaaatttgtaaaactaaagactttttgaaaaaaagctatcttaagtgctttttctttatttacaagacatttcccccagtggtagcatctgaagtattggagtgtttctgccacgaagcaaagctccattcatggccgtcatggaaggttatttattaatgttacataatggtagaatattactagttagagggttggatttgacttggtcctaaggccacagaatctctctcatggcttcctaagggatgtacctttatgcttttaagaactacaaagattcaataaagaaagaaatgtttttgaaactatagaaaaagattttaaaacacgctgctgtcctaaacaaatcctgtttaaaggaattttaaagagatgcattttactatatcaaagaacatacgtgtatttgcctaaacactctgtacctttgtaatgataaaacttcccccttctttacggtgaagcttattctgattaagcctagactgtgttctttttttttttttttttttttttttttttttttttttttttttttggtctgatgatgaatttgtgaactctatctttggtatatcttttattaaactgcactgttttgtttagtcaaggtaattaagtaattatgtatttgaataacttggtgtgtcttgagtgttgtggtatgaaaagcattgtggtctttctacactaatgaagtgcaaataaaattttgtatttatgaatga

SEQ ID NO: 1013 - DNA, 1158 bp, Homo sapiens
atggctcttccacatgattcaaacgaaacttcctatttgctgcctcccaacaatgaggactggggcaggcaaaccattcctgactttgtttatgggcagaaggatctcatggcagaagggattcagtggccaaggaatgcacctggcatcccagatgctctgccacaatctccctttgatgctgcactctgctctgcctggaagcagcgggtggagctggggctgtttcgctaccgtctacgggagctacagacccaaatcctccctggtgctgtgggtttcgtggctcagctgaatgtggagcgtggtgtgcagaggaggcccccgcagaccatcaagagtgtgaggcaggcatttgaccctgtacagttcaacttcaacaagatccggcccggagaagtcctcttccgtttgcaccgggagcctgatctccctgggactctgctgcaagaagacatcctggtggtgatcaacgtcagccccctggagtggggccacgtgctgctggtgcctgagcctgcccgccagctcccccagcgcctgctgccgggtgcactgagggcagggattgaggctgtgctgctgagcttacacccgggcttccgtgtcggcttcaacagcctgggaggcttggcctcggtgaaccacctccacctgcatggctattacctggcccacagactgcccgtggagcaggcgccaagcgagcccctggaccctggaggccatttgcatctgctccaggacctcccagctcctggcttcctcttttacactcgtgggccagggcctgacttggagtccttgataagcagggtatgtcgggccactgattatctgactgaccatgagattgctcataacttgtttgtcacccggggagctccgccgggaaagacatcaccttcctcagccctcacaggggtccgagtaattctgtgggcccggaagtccagctttgggataaaggacggtgaagctttcaatgttgccctctgtgagctggctgggcacctccctgtcaaaacatcccaggacttcagcagcctgacagaggcagctgctgtggccctcattcaggactgtcggctgcccccatcccaggcagaagacgtacaggcagcactggtggccctgatgtcccaggaagagcaataa

SEQ ID NO: 1014 - DNA, 555 bp, Homo sapiens
tgttgctacctaagccctccactcccgacaccatgctctgcgacaacttccccggggctgtcttcccaggatgctactggggcagctatggctacccgctgggatatagcgttggctgtggctatggcagcacctactctccagtgggctatggcttcggctatggctacaacggctgtggggctttcggctacaggagatactcgccatttgctctctactgattggctgaaatccccgaggtgtagcatcttctctcccttgaaggctgagccccacatctccaggttccccccgtatccactccttcagtcctcatttgctcatcaacctcagagacactgctttccaacttacctcgagtcccaggggaggaaaatgaaaaagcagacgcttcctcaagctgcctcccctggctgatgttctctgggacattttcggaaatttgacctcccacttgtcatgagctacttttgaattttccatgacactcatgacttgtgatgaagtcatggatatgtctatcaaaatctcaataaatttgtctcagctggt

SEQ ID NO: 1015 - DNA, 2356 bp, Homo sapiens
gaaccctgaagtcggtgtctgctgcgttcacggcaggattcggttaggaggaacagcacagcatgctgggctctggatttaaagctgagcgcttaagagtgaatttgagattagtcataaatcgccttaaactattggagaaaaagaaaacggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaaggaactagattctggtctggctgaatctgtgtctacattgatctgggctgctcctcgactccagtcagaagtggctgagttgaaaatagttgctgatcagctctgtgccaagtatagcaaggaatatggcaagctatgtaggaccaaccagattggaactgtgaatgacaggctaatgcacaagctgagtgtggaagccccacccaaaatcctggtggagagatacctgattgaaattgcaaagaattacaacgtaccctatgaacctgactctgtggtcatggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccatcagatttcaatggactgccaatggggacttatcaggcctttcccaatattcatccacctcagataccagcaactcccccatcgtatgaatctatgacattaatgctgataagaatatctcttctgcacagattgttggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgtcctg

SEQ ID NO: 1016 - DNA, 802 bp, Homo sapiens
aaacccgctctcgcccgcggatgggcgcgcagctgtgacgtcacggcgtcgttggtaaggggctggcggccggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcgagaagaccaagcgactcctgttcctcggggcccaggcctacctggaccacgtgtgggatgaaggctgtgccgtcgttcacctgccagagtccccaaagcctggccctacaggggccccgagggctgcacgtgggcagatgctgattggaccagacggccgcctgatcaggagccttgggcaggcctccgaagctgacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggactgcagtgacatgtacgagaaagtgctgtgcaccagctgtgccatgttcgagacctgaggctggctcaagccggctgccttcaccgggagccacgccgtgcatggcagccttccctggacgagcgctcggtgttcacactgaactgtggggtcgacgggaggggtgccttttacatgttctattttgtatcctaatgacagaatgaataaacctctttatatttgcacaa

SEQ ID NO: 1017 - DNA, 2972 bp, Homo sapiens
aactacaaaattgaaagtagagaggagggggcagccaatggaaaaaaaaatttgcacagcagccaatcctcctgcggcgttttgtgcctttgcccaacaggaaaatgtgtctcatgcagaggggcgttacccagtctccaatgggcgggagccggtggaacggaggagccaatgagtgcgagatgttgagtgacagctgtccaatggaggccctccgtgctagtacggcttgcggcttaagcgccgccgcggtctgcggaatgtcaactattcaacatggaggcggaggtcgataagctggaactgatgttccagaaagctgagtctgatctggattacattcaatacaggctggaatatgaaatcaagactaatcatcctgattcagcaagtgagaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagaggtcaagttgccaataaattattactgttaatgttctgggaaatgctgaaactatgctaagtgggggagagggaaagcaggtattgcagttttgtagtgaagattgggctttggagtcatatctgagatgtaagtagcagcttttaaattctagctatgaccctgtgcagatcacttaacttttgagtgtcaggatgtttggaaggacaagacaggaaagtgttttaatacagggttcagtatttagtaagccttcaataagtgatattacatacatgtaataaaaactaagcattgaaaggactaggaaaaatgcatcaaatgttagttctgcaggttatagaattatacttttatgtaattttaaaatttcagttatgaacatgtttgtccattaacaaacttataatagctgaaaaacagggttgtgagaacagcttcagttaaaattgtcctgtctagtttgaatatttcaagaacagaaagcctttttttttttttttttttttttgagacggagtctcactctgttgcccaggctggaatgcagtggtacgctctcagctcactgcaacctccacctcccaggttcaagcagttctctgccccaccctcccgagtagctgggattacaggcgcccgccaccacgcccggctatttttttgtatttttagtagagatggggcttcaccatcttgaccaggctggtctttaactcctgatggtgatccacccacctcggcctcccaaagtgctgggattacaggcatgagctaccgtgcctggcccccttttttttaattacagagaaataagttacaccttagtatcagatattaattttcttcagtgttcaggcaattagtatttagaaagctcttgtcatgagatggctctgggatgtgatgatgattgttgggattgaaaaaacggtagtatcatggagagatcataataaattcttagtattaaaagtggttttgctttcagttagggagaaaaattagattgtactatttttcctctatgatttccttcagttatcttccaaatgttgttttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttattgttaatagccactattctgttgtctggaattaaaacctgtataactaatttgcatccctttatcttcttagtcaataaaacctacaatcctctttctaaaatggt

SEQ ID NO: 1018 - DNA, 7043 bp, Homo sapiens
gcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtcataaataaagttcatcttaaggcaaatcatgtggtcaagagagatgttgatgagcatttaagaatcaagactgtctatgataaaagtgttgaagagttgctccctgagaaaaagaatcttgtaaagaacaagcttttcccacaagcgatttcttatttagagaagacttttcaggtccgtcgacctgcgggcactatcttacttagcagacaatgtgcaacaaaccaatacctccggaaggaaaacgatcctcacaggtactgcaccggggagtgtgccgcacacacaaagtgcggccccgttattgttcctgaggaacatctccagcaatgccgggtctaccgtgggggtaagtggcctcatggagcagtgggtgtgccagaccaagaaggcatctcagatgcagactttgttctttacgttggtgctctggccaccgagagatgcagccatgaaaacatcatctcttatgcagcctattgtcagcaggaagcaaacatggacaggccaatagcaggatatgctaacctgtgtccaaatatgatctctacccagcctcaggagtttgttgggatgctgtccacagtgaaacatgaggttattcatgccctgggtttctctgctgggctgtttgcattctaccatgataaagatggaaatcctctcacttcaagatttgcagatggcctcccaccttttaattatagtctgggattatatcaatggagtgataaagtagttcgaaaagtggagagattatgggatgttcgagataataagatagttcgtcacactgtgtatctcctggtaacgcctcgtgttgttgaggaagcacgaaaacattttgattgtccagttctagagggaatggaacttgaaaatcaaggtggtgtgggcactgagctcaaccattgggaaaaaaggttattagagaatgaagcgatgactggttctcacactcagaatcgagtactctctcgaatcactctggcattaatggaggacactgggagacagatgctgagcccttactgtgacacgctcagaagtaacccactgcagctaacttgcagacaggaccagagagcagttgccgtgtgtaatttgcagaagttccctaagcctttaccacaggaataccagtactttgatgaactcagtggaatacctgcagaagatttgccttattatggtggctccgtggaaattgctgactactgccctttcagtcaggaattcagttggcatttaagtggtgaatatcagcgcagctcagattgtagaatattggaaaatcaaccagaaatttttaagaactatggcgctgaaaagtatggacctcattccgtttgtctaattcagaaatcagcattcgttatggagaagtgtgagaggaagctgagttacccagactggggaagcggatgctatcaggtttcttgttctcctcaaggtctgaaagtttgggtccaagatacttcatatttgtgtagtcgggctgggcaggtcctccctgtcagtatccagatgaatggctggattcacgatggaaacctgctctgcccatcatgttgggacttctgtgagctctgtcctccagaaacagatcctccagccactaacctgacccgagctctgccacttgatctttgttcctgttcctcgagcctggtggtcaccctctggcttctgctaggcaatctgtttcctctgctggctggatttcttctgtgtatatggcactaggaatggaaaagtggatcttcaagatattcttttatgttatgttcttgtgaacaaagcacaaagtttgagtgagtgccaacctatgcagatggtagaagtggcattcctggctttggcttggaagaattgacgaccatcagaccttgaagcagaacttcacagcagcctgtcctcatcagcaacccaaccaccttcatcagcaacccaaccaccttcatcagcaacccaaccacctcgtcagcaacccaaccacctcgtcagcaacccaaccacctcgtcagcaacccagccaccttcatcagcaacccaaccacctcatcagcaacccagccaccttcatcagcaacccaaccacctcatcagcaaaccaaccactttcatctgcaacccaaccactttcatcagcaactcaacaccttcatctgcaacccaaccaccttcatcagcaaaccaaccaccttcttcagcaacccaaccacctcatcttggagaaggagaaggaactgcaagccaccaagtcttcatttttcagggtttgtaatcttcccaaagttttcctttgaaaataggataatgggtggaattttcagagtgattacatacctcaacatttttattaacatacaacaatgggaaagttcatcatccatatactgcagtcacttaaacaacagccaattattgcaagattagaattggagatcttgtcctcaaaagtataaattgtcctttgagttatagaaaataatggaattgggatttctacatatcattattatacctattttaaatttaatggcagccaggcatggttccagctacttgggaggctgaggcaggaggatcgcttgagcccaggagttcaaggctgcagtgagctatgattgcaccactgtattccagcctgcacgatagagttagaccctgtatcttaaaaaaaaaaaaattaatggctggtatatagtaaacttaattcactgttcccattgttctaaagaatttttttaaataatgtttcattaaatcttatgatttaaccgtgcttgccctttttgccagctatgtggcagtttacggcagaactgctgtcagtgtgctggtagccctctattcatccctcctcagagcccagcttccagaactgctatcactgtgctggtagccctctgtattcatccctcttcagagctcagcttctggttgtattctccatgagtttaataatgacatgaaaaaatgtggaagccgagagagtaaaatactctgccctgtaaaaacatggaagacatgcaaacagaaaaaaaataattgtattgttttagataatacttaagacaactgtgaaacaacaaaaacacaactattcctttgtgaccgatgaagataaaaagaaattctggtaaagacgggtatgcagttttttaaaatgggttaagaaattgttgcagaagaatttctaacatctgaaaatggttttatgtttaagaaggatggtctgaattgtgtactaatagcaaggtataagtttggtgtagagcctatccagtagcgtccactgtaccacttttaagtaagactcagtccacagaagctggaagattgccttcgctttaaatatcctttaccttctgcatttgacactcctcctgttactacatagattccggtccccagaagcaattttacactggtactagagcttaccagccccatttagtaatttttaatggctagatgaggtttaacaagaatatgaaaagaaaaaagaaaaaatatattcatgaatgataggcgatgcccattctttctctcaagctaatgaagtcctatggcattctaaccacaaccctcggacagactcctcctattcctccatggcattgtaaccacaaccctcggacagactcctcctattcctccatggcattgtaaccacaaccctcggacagactcctcctactcctccatggcattgtaaccacaaccctcggacagactcctcctactcctccatggcattgtaaccacaaccctcggacagactcctcctactcctccatggcattgtaaccacaaccctcggacagactcctcctattcctccatggcattgtaaccacaaccctcggacagactcctcctattcctccatggcattgtaaccacaaccctcggacagactcctcctattcctccatggcattgtaaccacaaccctcggacagactcctattcctccatggcattgtaaccacaaccctcggacagactcctcctattcctccatggcattgtaaccacaaccctcggacagactccttctgttcctcctttcctcgtccttccctgcttttcgtccattcagcatatagctattcagtactccattgaagaaattatgctaagtgagcaaagcaacataattactaagaattaattctgattatttggcactagagccaacagcaaccccagcacagaggaaagtcgcttttttttcaaatgcataaatttaaagtatgtatttgcatgcagttttaaatgggaggtatttgtcattgtgaaaagctgggaatctcaaacatagtcaacttaactaaaaagaagctaatacaggttgagcattcctaatccaaaaatccagaatccaaattgctccaaaatctgaaactttctgaatgctgacctgatactacaagtagaaaattccacatacaagtacttaacacaaactttgtttcatgcacaaactactaaaaatattgtataaaattaccttcaggcagtgtgtgtagttatatatgaaacatgaatttcatgtttagacttgggtccatgcccaagatacctcattaggtatctgtaaatatccgaaatccaaaaaaaagtctgaaatctgaaacacttctggtcccaagcatttcagtaagtgatgctcaacctgcgtaatggtctgcgggccagtgctcattttctgcctatgttgtacatactttaaattgtgtaaattaaaagtcaaagcaaagagtctatttttaaagaaacttacaataatctaaacatatacttcttatgattatgaatcatcctgcaaagctgaatgaagaattttaccaaaaatacaatgaattaatcatatatttgagagtcacagtgataggttcgactatattttgactgttgtgtagtggcaccgtttaggtagtattgtttctgagcatggtgctttttatacttgaaatatatttttgctttattttttattgatataattatatttgcactaatggctttctgaagaaaatattatagatgacattttttgtatatatatttattaagcttgggaacctggtcgcccagtgttttctctggacaaatgtgaaactggataaagtatggataaagtcttgagttcctcagggtaactgtgttgatgtctcccgtcctcttcagtaaggcttgaatatgattttactcatcattgattctgcatagtgtacccagcaagacttagaaggacactgaacctgtcagagattttaagaggcacattttagtcactttgaatatggtagtggtgggcgcggtgactgaagcctgtaatctcagcacttcgggaggccaaggcaagcagatcacgagatcaggagtttgaggttacagtgagctgatcgcaccactgcactgcagcctggatgacagagtgagactttcttgggaaaaaaaaaaatgacagtgaagcagacttttagaatccgagatgtcattgcagaattattggtataaaattcagctgcaaagtgaagaaattgaaatggcccacacgttgatatcctgtggcaggttatacccttcatgttagcaaagacgaagccacgtcgctgtgttaagagggacaggctgggccggctgcagctgtagtggaagtgagggacacagggaaggaatggggagcagcaatttggggacagtagactggagtcactttctgactcaaaaagggtcaagtacttattaaaaactatcttggttttctgttcagacttaggctcattttgatcattttaaggtcccagttgtcaaaaatatcaagtgaatttgtctcaggttttcagaaacaaaatttacaggaaggaagcaaaagccatgtcagtagccttgagctgacagctttaaagaaactggcaaacaggtaggttgtcctcatatagatccttccagtattctgaaaaacatccttttatttcttaaaaccagtaacccttacatttttcctataggatagttatttttgttgagatcaaatagacattctataaatgttataaattatgcttgcagttactcagcctatctaggcttaaggtttatcaatatttgaagttgaaacatcatcttatgaggtttagttttaggaagataaataaatatatcaaagtatttcataaagttgtatcaatgttccttctaacattagaagacttactgactgaggccatctgtgaacgactaggtgatctcagaatccttccagctctaataccctctgactaacactcacccagaattgctgtctgtgctggctgtgatctgcctccaggagcatacgccatcctgcgtgctgtgtccatcacagtgtctgtgctcggtgccttaccactgtccgtgtccttggacgctgactggacagagaggagcctgtctctcagggcacatgagtcgtcgtggcaggaggagacgggcctcagtcacagtgtcacagacccttgtcacagtggacactagtcattcctgccatgtccttgcagcccaggaggactaaaaagattttaatgaagtctgtgttactcattctgaagaaaagaacttacctgagaggagtaatatttttttaatatatattgggtcagggacagggatggagtggttgttttatgtttacatttttaataagtaaaatagaagatttaagaactaatatttatggtattgaactttaagtgtgatatattccttagaaaaacacaactttaataaaaatggaaactaa

SEQ ID NO: 1019 - DNA, 592 bp, Homo sapiens
actccgccagggggcgctgtgtggctcccgagtaggctcagagcgaccgtggccgggcggaagcggctttctggcctaagctttaacaggcttcgcctgtgcttcctgtttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagc

SEQ ID NO: 1020 - DNA, 2001 bp, Homo sapiens
agaattccgtggctttggaaaataaaactgctgttatagctcttctgggtatttgagaaatgcacttgtgaagggttagagttgaatcttttgatgcgaaagtcgggttttcctgatactgggattccgggattccaggtgttggggtggcccaattcctgcgagaagcaatagcgggcggtaacatgaggagcacggtgcgtccagcgagtccttccgcctggggccctgccgaccccctgcctgcgcccccaggactctggcctcacccggccgtgccggggcctctgtgacgcggcgttccaggcactcggccccggccgagcccgtagctagagcggctcagagacaggaggcggcggcagcagcggcggcatgaaccactgccagctaccggtggtgatcgacaacggctcgggaatgatcaaggcgggcgtggctgggtgccgggagccccagtttatctacccgaacattatcggccgcgccaagggccagagccgcgcggcccagggcgggctagaactctgcgtgggcgaccaagctcaggactggaggagctcgctgttcatcagttacccagtggagcgtggtctcattacttcatgggaggacatggagatcatgtggaagcatatctatgactataacctaaagctgaagccgtgtgatggcccagtcttgattactgagccagcgctgaacccactggccaaccggcaacagatcacggaaatgttttttgagcatctgggtgttcctgccttctatatgtccatccaggctgtgctggctctctttgctgctggcttcactactggccttgtgctgaattcaggtgctggggttacccagagtgtgcccatctttgagggttactgtctgcctcatggtgtgcagcaactggatctggcaggccttgacctcaccaactacctcatggtgctaatgaagaaccatggtatcatgttgctcagtgcttcagacagaaagattgttgaagacatcaaggagagcttttgttatgtggcaatgaactacgaagaggaaatggccaagaaacccgattgtctagagaaagtttaccaactacctgatgggaaggtcatccagctccatgaccagctcttttcttgtccagaggccctcttctctccgtgtcatatgaaccttgaggcccctggcattgataagatatgcttcagcagcataatgaaatgtgatacaggcctgaggaattccttcttttccaatattatccttgccgggggatcaacctctttccctggtttagacaagcggttagttaaggatatagcaaaggtggctcctgccaacaccgctgtgcaagttatagctcctccagaaaggaaaatatcagtgtggatgggaggttctattcttgcatccttgtctgccttccaggacatgtggatcactgctgcagaatttaaagaagttggacccaacatagtacaccaaagatgcttctgaaatacagataaaatggttggaagaaaatgttttgagtatatgtgacagaaaactttggatattatatgtttctgggagaagagaaaatacttcacctattgggatgccaatatttctgttgtatttctataatgggtttgggggataataatggtgaagctcaagaacagatgtctattgagtagaaccaagttaaaataatgtttcccatagtgtttcttctataacttgacgttggtgagcttatatttcccttggaagagagcatttgtggtacaatatgctatgtgccaaatgagtgataagatttaagcttattgaagtttagggaaagaaggttgctgtggtgaggaacgagactccatagcagaggtatgccatcatggaaggggtggcattgggatggagcgcagatatccaggcaagcatactaaaatgaacaagttgctaaagatgagaatgaacaaagcatattcagggcatgtttaatagactgattttgttttt

SEQ ID NO: 1021 - DNA, 3731 bp, Homo sapiens
agtccccgaggtcacaaggcagtggcaggtgtctgtagtcctcgggttgactgcagctcgcggtggtccctctccgagcccaggaagccactccagtgccgagggagaggcctgggagcgctcggagtgtgcgcggactggagaagggggaggtggcggagtgattcgtagagtaaattcggtaccgaggggcggggtcggggatttgaatcggtcggcgggcggaggaggcgggtggaggaggctgccgggcagagcgcaggccaggatcagcgcaggctgtgagtccaggtcagccgtcgggacctcgggctccgggttcgaagagcggctcccggctgcgggtgctttgccaggagagcccttccggacagaggagccggggtctggaaggagcggccgacgcgacgctcgcctgccacggggctctgggagtaagcctgtctgcctggcgggccttcaggtgcggcgtgagagatggatgccaattcaaaagacaagccccctgaaaccaaggagtctgcaatgaataatgctggaaatgcctctttcattttgggaactgggaagattgtgactcctcagaagcatgccgaattacctcctaatccttgcacaccagatacttttaaatcacctttgaacttttccacagtaaccgtagagcaattgggaattacacctgaaagctttgttaggaactctgcaggaaagtcatcatcctaccttaaaaaatgtagacgacgttctgcagtcggtgctcggggctctcctgaaacaaaccatctgattcgtttcattgctcggcagcaaaatataaagaatgctaggaaatctcctttggcacaagattctccttcccagggcagccctgcactgtatcgaaatgttaacactttaagagaacgaatatcagccttccagtcagcttttcactccataaaggaaaatgagaaaatgaccggctgtctggaattctcagaggcaggaaaagagtccgagatgacagacttgaccagaaaggaaggtctcagcgcttgccagcagtctgggttccctgcagtgttgtcctccaaacgtcggagaatatcctatcagagagactctgatgaaaatctgacggatgctgaaggaaaagtaattggtctccagatattcaatattgatacagacagagcatgtgcagttgaaacttctgtagatctttctgagatatcatctaaacttggttcaacacagtctggatttttagttgaagagtctcttcccctttcagagctcacagagacttcaaatgcactaaaggttgctgactgtgtagtgggcaaaggatcaagtgatgccgtttcgcctgacacgttcacagcagaagtgagctcagacgcagtccctgatgtcaggtcaccagctactccagcctgcaggagggaccttcccacccccaagacctttgtacttcgttctgtactgaagaaaccctctgttaagatgtgtctagagagcttacaggaacactgtaacaacctctatgatgatgatgggactcatccgagcttaatctcaaatctcccaaactgttgcaaagagaaagaagcagaagatgaagaaaattttgaagcacctgcctttctaaatatgaggaagaggaagagagttacttttggagaggacttaagcccggaagtgtttgatgaatctttgccagcaaatactccattgcgtaaaggaggaacacctgtttgtaaaaaagacttcagtggtctcagttccctgctgcttgagcagtcacctgttcctgagccattacctcaaccagattttgatgacaagggggagaatcttgaaaacatagaaccacttcaagtatcatttgccgttctcagttctcctaataaatcatcaatctctgagaccctttcaggcactgatacctttagttcttcaaataaccatgagaaaatatcctctcctaaagttggtagaataacaaggacttctaacagaagaaatcaattggtcagtgttgtagaagagagtgtttgcaacttattgaatacagaagttcagccttgtaaagaaaagaaaattaataggaggaagtctcaagaaacaaagtgtacaaagagagcacttcctaagaagagtcaggttttaaaaagttgcagaaagaagaaaggaaagggaaagaaaagtgttcagaaatctttatatggggaaagagacattgcttctaagaagcccctcctcagtcctattcccgagctgcctgaagtccctgagatgacaccttccattccgagcatccgaagactgggttcaggttatttcagttcaaatggcaaactggaagaagtgaagactcctaaaaatccagtgaaaagaaaggatcttttgcgtcatgacccagatttgcatatgcatcaaggctatgataaatatgatgtctctgaattctgctcttatataaaaagttcctcatcgcttggcaatgctacttctgatgaagatccaaatacaaatataatgaacattaatgaaaataaaaatattccaaaagcaaaaaataagtcagaaagtgaaaatgaaccaaaagctggaactgacagtcctgtttcttgtgcttctgtaactgaagaacgtgtggcatcagatagtcccaaacctgctctgaccctgcagcagggtcaagaattttctgctggtggtcaaaatgcagaaaacctttgtcagttctttaaaatttcaccagatttaaacataaagtgtgaaagaaaggatgacttcttaggagctgcagaaggaaaactgcaatgcaatcgtttaatgcctaattcacaaaaagactgtcattgtttaggagatgtcttaattgaaaatacgaaagaatctaaaagccagagtgaggatttgggaagaaaacccatggaaagtagcagtgttgtgagttgcagagacaggaaagatagaagacgttccatgtgttattctgatggtcgaagtttacatttggaaaaaaatggaaatcacacaccatcctccagtgtgggcagctctgtagaaattagtttagaaaattctgaactgtttaaagatttgtctgatgccattgagcaaacctttcagaggagaaatagtgaaaccaaagtgcgacgtagcacgaggctacagaaggatttagaaaacgaaggtcttgtatggatttcacttccacttccttccacttcccaaaaagccaaaagaagaacaatatgtacatttgacagcagtggatttgaaagtatgtctcccataaaagaaactgtgtcctccagacaaaaaccgcagatggcacctcccgtctcagatccagaaaacagccagggccctgctgctggttcttccgatgaacctggtaagaggaggaagagcttttgtatatctacacttgcaaatactaaagccacttcccagttcaaaggctaccggagaagatcctctcttaatgggaagggagagagctctctgactgccttggaaaggattgaacataatggagaaagaaagcagtaattgacatttcctgcagagtctgtggcaagagggaaagtaaccatctatgctgaaatgatctgtctagttcccattctctgttcaacctcagtgtttcaaaagttcctaataaataaactcatttgagttgaacctacttttatgtagaaataaataagtttcttcatcattcagatagaaaa

SEQ ID NO: 1022 - DNA, 1706 bp, Homo sapiens
cccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtaacaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgattt

SEQ ID NO: 1023 - DNA, 2530 bp, Homo sapiens
gaagcgattgcgagccagcgcgcgcgcttcggcgttcccggcggtctgcgaagtttccggagcccgggtcccgccgcgggttcgcgcttgtgctcgcgctcgttcctggagtcggcggccgctgcgcgcgctcgttgcccaacccggtccccgcccccagacacgccgggctctcggggcaccacagccatgtgctcgttagcgtcaggcgctaccggttattcacatctgctgaagaaacattttcacactgtaagtctgagcatcagtttaatattgacagcatggttcataaacatggacttgaattttatggatacattaagctaataaattttattagacttaagaatcctacagttgagtacatgaattccatatacaacccagtgccttgggagaaagaagagtatttgaagccagtattagaagatgaccttttacttcaatttgatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaaacaatttgctcaggattttgtgatgcacacagatgtcagaacctgctcgtcatctactagtgtcattgcggacctccaggaggatgaggatggtgtttatttcagctcatacgggcattatgggatacatgaagaaatgctaaaggacaaaatacgaacagaaagctaccgagatttcatataccaaaatccacatatcttcaaagacaaggtagttttggatgttgggtgtggaactggaattctctctatgtttgctgctaaagctggggcgaagaaggttcttggagttgatcaatctgaaatactttaccaggcaatggatattataagactaaataaacttgaagatactattacactaattaaaggaaagattgaagaagttcatcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcagttaaagcaggtgaagccttgaaaggaaaggtcacagttcacaagagtaagaaagatccacgttctctcaccgtgaccctcacgttgaataattcaactcaaacttatggtctccagtgaaacagccataaaagcacactaccttgtagtttttaatgtgggggtagagtgggtcagcaggagggagctggttttatgtgagcagatggatggatgatggaccctttcctaatgagcctcctcaataagagagaagttctcattgtgggaatctgacatagttcagctgaggaagagaatcagctgatcctcatggtctgccacgtaatcattttcttagacgtttgctccaccagatttaaccaaatgtaactcccacattgagtttatctatattgaaaatcatttacattggcctatatttggaagagagatagtcttttgtttttaataagtttcttactataaattttaaacaaattggttagttatttggatattttattaaactagtaacacaggtactacacattttattatggactcctctgaggaggagtttttaattgtatttgctagaaaatcaggatgtaataaagatttgtataaaaaaactaaaatatggaaaagagcttcagccttcatatacaaatcatatatgcagacagcctagttgattatctagcatacttagggttctcattttgtagtttcttccctctttgtgactattccttagccttatagatttctagtactgcccaggaaatctaatttcaatacatttatcctaggtttcatgaaagtttttaaagattgggataaatatgtacttatttactaacgtattatctttttcaaaccagatttatgtgcaaaggttaaacatgtaactgttactaagcagtctataaagttgtcatttacaattactgattcaatttgaaatgtagaataaaattttaataaaatgtatcaacttataaaatattttaaaaata

SEQ ID NO: 1024 - DNA, 384 bp, Homo sapiens
ctcaaccaaatcctccactcttgaaaccatgtgctactacagcaactactatggtggtctgcgttatggctatggagtcctgggcggtggctatggctgtggctgtggttatggccatggctatggaggcctgggctgtggctatggccgtggctatggtggctatggatatggctgctgccgcccatcttgctatggaagatactggtcctgtggcttctactgagaaatatctggcaactcaacctcgtggtctcttccacatggacttcctaaatttgccttcataattcttcatatgagtaattcatttttctgttgtaaaatgtcaacatcatccttaagtatctggaagaaaaaataggtcagatgctgcaagcctca

SEQ ID NO: 1025 - DNA, 7734 bp, Homo sapiens
agtagaggtgaccgaggcggtggcggcggaggcggcaccgattgctgtgtcggccccagtgcggccgaagtcgcggtagagcgtagccccacgcccctcccccgtccgcgccctccctctttccctggggatggagaaggcgacggttccggtggcggcggcgacggctgcagaaggagaagggagccccccggcggtggcggctgtggcgggcccccccgcggcggcggaggtcggcggcggcgttggcggcagcagcagagctcgctcggcctcgtctcctcgtgggatggtgcgagtctgcgacctgctcctgaagaagaagccgccgcagcagcagcaccacaaggccaagcgtaaccggacttgccgaccccccagcagcagcgaaagcagcagcgacagcgacaacagcggcggcggtggaggcggcggtggaggcggaggtggcggcggcggcaccagcagtaacaacagcgaggaagaagaggacgacgacgacgaggaagaggaggtttctgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgttggatgaagctgctgctgcacttacccgtatgagagctgaaagcacagcaaatgcagggcagtcggacaaccgcagtttggcagaagcctgttcagaaggagatgtaaatgctgtgcgaaagttactcattgaagggcgaagtgtaaatgaacacacagaggaaggggagagcctcctttgtttagcttgttctgctggatactatgagcttgcacaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggacacttagagatggtgcgatttcttttggaagcaggcgcggatcaagagcataaaacagatgaaatgcacactgctctgatggaggcttgcatggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcagctcgagaaggacatgaagaaatggtggcattacttcttggtcaaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggagctaacgttcatgcaacaacagcaacaggggatacagcactaacatatgcctgtgaaaatggtcatactgatgtagcagatgtcttacttcaggcaggcgcagatctggaacatgaatctgaaggtggaagaactcctttaatgaaagctgcaagagctggtcatgtttgtactgttcagttcttaattagtaaaggagcgaatgtgaatagaaccacagctaataatgaccatactgtactgtccctggcttgtgcagggggtcatctggcagtggtggaactacttttggctcatggggcagatcctactcaccgtttgaaagatggctcaactatgttgatagaagcagcaaaaggtggccatacaagtgttgtttgctatctcttggattatcctaataacttgctttcagcccctccaccagatgtcactcagttaactcccccatcccacgatttaaatagggctcctcgtgtaccagttcaagcactgcccatggttgttccacctcaggagcctgacaaaccacctgccaatgttgccaccactcttcccatcaggaataaagcagtcagtggaagagcatctgcaatgtcaaacactcctacccacagtattgctgcatccatttcccaacctcagactccaactccaagtcctatcatctctccttcagccatgcttcctatctaccctgccattgatattgatgcacagactgagagtaatcatgacacggcactaacacttgcctgtgctggtggccacgaggaactggtacaaacactgctagagagaggagctagtatagagcaccgagacaagaaaggttttactccactcatcttggctgccacagctggtcatgttggtgttgtggaaatattgctggacaatggtgcagacattgaagcccagtctgaaagaaccaaggacacaccactctccttggcttgttctgggggaagacaggaggtggtggagctattgttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggagatgctgaagaagtgtcatctttgtatggagtcaatagtacaagccaaagatagacaggctgctgaagcaaacaaaaacgccagcattttgttagaggagttagacttggaaaagttaagggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagaaggtgaatggagagtccaagagcagcagtaccagcgagagtggggacagtgataacatgaggatttccagctgcagcgatgaaagtagtaacagcaacagcagtcgtaagagtgacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatgattcttctgcacagtcagtatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataa

SEQ ID NO: 1026 - DNA, 1766 bp, Homo sapiens
ccccggcccggctccatttaatggcgcggacgccggcggcggcgggctcctggccgggccagcgcagcggaagagccaagccagcatgtcggggacccgagcctccaacgaccggccccccggcgcaggcggcgtcaagcgggggcggctgcagcaggaggcggcggcgaccggctcccgcgtgacggtggtgctgggcgcgcagtggggggacgagggcaaaggcaaggtggtggacctgctggccacggacgccgacatcatcagccgctgccaggggggcaacaacgccggccacacggtggtggtggatgggaaagagtacgacttccacctgctgcccagcggcatcatcaacaccaaggccgtgtccttcattggcaacggggtggtcatccacttgccaggcttgtttgaggaagcagagaagaatgaaaagaaaggcctgaaggactgggagaagaggctcatcatctctgacagagcccaccttgtgtttgattttcaccaggctgtcgacggacttcaggaagtgcagcgccaggcacaagaggggaagaatataggcaccaccaagaagggaatcggaccaacctactcttccaaagctgcccggacaggcctccgcatctgcgacctcctgtcagattttgatgagttttcctccagattcaagaacctggcccaccagcaccagtcgatgttccccaccctggaaatagacattgaaggccaactcaaaaggctcaagggctttgctgagcggatcagacccatggtccgagatggtgtttactttatgtatgaggcactccacggcccccccaagaagatcctggtggagggtgccaacgccgccctcctcgacattgacttcgggacctacccctttgtgacttcatccaactgcaccgtgggcggtgtgtgcacgggcctgggcatccccccgcagaacataggtgacgtgtatggcgtggtgaaagcctataccacacgtgtgggcatcggggccttccccaccgagcagatcaacgagattggaggcctgctgcagacccgcggccacgagtggggagtgaccacaggcaggaagaggcgctgcggctggctcgacctgatgattctaagatatgctcacatggtcaacggattcactgcgctggccctgacgaagctggacatcctggacgtactgggtgaggttaaagtcggtgtctcatacaagctgaacgggaaaaggattccctatttcccagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcagtcaaatgggttggtgttggcaagtcaagagagtcgatgatccagctgttttagtcacagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaa

SEQ ID NO: 1027 - DNA, 2653 bp, Homo sapiens
acgtgacccgcacggcgcctcgaggccggaagcgattgcgagccagcgcgcgcgcttcggcgttcccggcggtctgcgaagtttccggagcccgggtcccgccgcgggttcgcgcttgtgctcgcgctcgttcctggagtcggcggccgctgcgcgcgctcgttgcccaacccggtccccgcccccagacacgccgggctctcggggcaccacagccatgtgctcgttagcgtcaggcgctaccggcggccggggcgctgtggagaatgaggaggacctgccagaactgtcggacagcggggacgaggccgcctgggaggatgaggacgatgcagatctcccccacggcaagcagcagaccccctgcctgttctgtaacaggttattcacatctgctgaagaaacattttcacactgtaagtctgagcatcagtttaatattgacagcatggttcataaacatggacttgaattttatggatacattaagctaataaattttattagacttaagaatcctacagttgagtacatgaattccatatacaacccagtgccttgggagaaagaagagtatttgaagccagtattagaagatgaccttttacttcaatttgatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaaacaatttgctcaggattttgtgatgcacacagatgtcagaacctgctcgtcatctactagtgtcattgcggacctccaggaggatgaggatggtgtttatttcagctcatacgggcattatgggatacatgaagaaatgctaaaggacaaaatacgaacagaaagctaccgagatttcatataccaaaatccacatatcttcaaagacaaggtagttttggatgttgggtgtggaactggaattctctctatgtttgctgctaaagctggggcgaagaaggttcttggagttgatcaatctgaaatactttaccaggcaatggatattataagactaaataaacttgaagatactattacactaattaaaggaaagattgaagaagttcatcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcagttaaagcaggtgaagccttgaaaggaaaggtcacagttcacaagagtaagaaagatccacgttctctcaccgtgaccctcacgttgaataattcaactcaaacttatggtctccagtgaaacagccataaaagcacactaccttgtagtttttaatgtgggggtagagtgggtcagcaggagggagctggttttatgtgagcagatggatggatgatggaccctttcctaatgagcctcctcaataagagagaagttctcattgtgggaatctgacatagttcagctgaggaagagaatcagctgatcctcatggtctgccacgtaatcattttcttagacgtttgctccaccagatttaaccaaatgtaactcccacattgagtttatctatattgaaaatcatttacattggcctatatttggaagagagatagtcttttgtttttaataagtttcttactataaattttaaacaaattggttagttatttggatattttattaaactagtaacacaggtactacacattttattatggactcctctgaggaggagtttttaattgtatttgctagaaaatcaggatgtaataaagatttgtataaaaaaactaaaatatggaaaagagcttcagccttcatatacaaatcatatatgcagacagcctagttgattatctagcatacttagggttctcattttgtagtttcttccctctttgtgactattccttagccttatagatttctagtactgcccaggaaatctaatttcaatacatttatcctaggtttcatgaaagtttttaaagattgggataaatatgtacttatttactaacgtattatctttttcaaaccagatttatgtgcaaaggttaaacatgtaactgttactaagcagtctataaagttgtcatttacaattactgattcaatttgaaatgtagaataaaa

SEQ ID NO: 1028 - DNA, 1920 bp, Homo sapiens
ccctttcctttatcatgtgtctgtattgtgtaccctccttcatttccgaaattcaaacaaacaaaaaaagccagcgtctaaaaggccagatggccgatagcggacccctcctcctgcccccaatttcaagcttaaagtagccagcgtggattctgatttcaaaatagaagatgagttgtcacactccctggaccatttcttcagcacaacacagttttagggggagcctcaggatatacgtgcacatgtccttgggccaggatgtccgtactaagccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtga

SEQ ID NO: 1029 - DNA, 1095 bp, Homo sapiens
gagccgatgcccgattccgcgcccgccatggccgacaaaatggacatgtctctggacgacatcattaaactgaaccggagccagcgaggcggccggggcgggggccggggccgcggccgggccggctcccagggcggccgcggcggtggggcgcaggccgccgcgcgagtgaatcgaggcggcgggcccatccggaaccggccggccatcgcccgcggcgcggccggcggaggcggcaggaaccgaccggcgccctacagcaggccaaaacaacttcccgacaagtggcagcacgatcttttcgacagtggcttcggcggtggtgccggcgtggagacaggtgggaaactgctggtgtccaatctggattttggagtctcagacgccgatattcaggaactctttgctgaatttggaacgctgaagaaggcggctgtgcactatgatcgctctggtcgcagcttaggaacagcagacgtgcactttgagcggaaggcagatgccctgaaggccatgaagcagtacaacggcgtccctctggatggccgccccatgaacattcagcttgtcacgtcacagattgacgcacagcggaggcctgcacagagcgtaaacagaggtggcatgactagaaaccgtggcgctggaggttttggtggtggtggaggcacccggagaggcacccgcggaggcgcccgtggaagaggcagaggtgccggcaggaattcaaagcagcagctttcggcagaggagctggatgcccagctggacgcctataatgcgagaatggacaccagttaaacagaccagcaaatccgcgtgcggaacaggacccaggcgtctcctcttgctccctggttggggggcggtggctggggctgtgcggccaatgatggatttgtttcttttatgttttaaaataggatttaaaaactcatgtaaaggttttttttttttctttttttttttttttaattctgaaacagacctgttttgtaccgagttatttttgggataaattttactggttgctgttgtggagaaggtggcgtttccaccttttccataataaaatagaaatgtgtgtagaactgg

SEQ ID NO: 1030 - DNA, 876 bp, Homo sapiens
atgggagtggcggcgcggcccccagccctgcggcactggttcagccactcaattcctctcgctatcttcgcgctgctgctgctttatctcagtgttcggagcctaggcgcccgctcgggctgcggacccagggcgcagccctgcgttccaggggaaacggcgcccttccaggtccggcaggagtcgggaaccctggaggccccggagaggaaacagcctccgtgtctgggccctcgggggatgctgggccgcatgatgaggcggttccacgccagtctgaaacccgaaggggatgtggggctgtcgccgtacctggcgggatggagggcactcgtcgagttcctgactcccctcggctccgtcttcgccttcgccactagggaggccttcaccaaggtgacagacctggaggctcgggtgcacggcccggacgcggagcactactggtcgctggtggccatggcggcgtgggagcggagggcgggactgctggagcagccgggggcggccccccgggacccgacccggagctcgggctctcgcacgctgctcctgctgcaccgcgcgctgcgctggtcccagctctgcctccaccgggtggcgaccggcgcgctgggaggcccggacgcgggcgtgcagtgcagcgacgcctaccgtgcggccctgggtccgcatcacccctggctggtccgacagaccgcccgcctcgccttcctcgccttcccgggtcgccgccgcctgctggagctggcgtgtcccggagccaccgaggcggaggcgcgggccgcgctggtccgggccgccggcaccttggaggatgtctacaaccgcacccagagcctgctggccgagcgcggcctgctccagctggcctaa

SEQ ID NO: 1031 - DNA, 3959 bp, Homo sapiens
cggacggggccgccccgatgggacgccgcgctccggcccctgcgcgccgctgagccgagcgccccccgctgccgagacccccgccgccaccgccagccgctgccccctcgcccccgcccgggccgggagcctcgtccccgtcccccggaaagctggatttccgaggctggaggcgcctggccggctgggtggggaccaccatgggcaacgcggccggcagcgccgagcagcccgcgggccccgccgcgccgccccccaagcagcccgcgcctcccaagcagccgatgcccgcggccggagagctggaggagaggttcaaccgcgccctgaactgcatgaacttgcccccagacaaggtccagctgctgagccagtatgacaacgagaagaagtgggagctcatctgtgatcaggagcggtttcaagtcaagaatccccccgcagcctacatccagaagctgaagagctatgtggatactggtggggtcagccgaaaggtagcagctgattggatgtccaacctggggtttaagaggcgagttcaggagtccacgcaggtgctacgggagctggagacctccctgaggaccaaccacattgggtgggtgcaggagttcctcaatgaagagaaccgtggcctggatgtgctgctcgagtacctggcctttgcccagtgctctgtcacgtatgacatggagagcacagacaacggggcttccaactcagagaaaaacaagcccctggagcagtctgtggaagacctcagcaagggtccaccctcctccgtgcccaaaagccgccacctgaccatcaagctgaccccagcccacagcaggaaggccctgcggaattcccgcatcgtcagccagaaggacgacgtccacgtctgtattatgtgcctacgcgccatcatgaactaccagtctggcttcagccttgtcatgaaccacccagcctgtgtcaatgagattgctctgagcctcaacaacaagaaccccagaaccaaggctctggtgctggagctgctggcggccgtgtgcttggtgcggggaggacatgacatcatccttgcagcctttgacaacttcaaggaggtgtgtggggagcagcaccgctttgaaaagctgatggaatatttccggaatgaggacagcaacatcgacttcatggtggcctgcatgcagttcatcaacattgtggtacattcggtggagaacatgaacttccgtgtcttcctgcaatatgagttcacccacttgggcctggacctgtacttggagaggcttcggctcaccgagagtgacaagctgcaggtgcagatccaggcgtacctggacaatatttttgatgtgggggcgctgctggaggacacagagaccaagaacgctgtgctggagcacatggaggaactgcaggagcaagtggcgctgctgacagagcggcttcgggacgcggagaacgaatccatggccaagattgcagaactggaaaaacagctaagccaggcgcgcaaggagttggagaccctgcgggagcgcttcagcgaatcgaccgccatggggccctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccagatctcgcacctgcagcagagccggctcccggagcagcgccaccgccgccgcccccactgcccggcctcccctccccgcaggaagccccgccctctgcgcccccacaggccccgcctctccctggcagcccggagcccccgcctgcgccgccgctgcccggagacctgccgcccccacccccgccaccgccaccacctccgggcactgacgggccggtgcctccgccgccgccgccgccgccgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagtgatcaagacggtgcccttcacggcccgcaccggcaagcggacatcccggctcctctgtgaggccagcctgggagaagagatgcccctctagcccctcagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgc

SEQ ID NO: 1032 - DNA, 3175 bp, Homo sapiens
gggagcgagccggtgctgctgcaggctgaggctgcggcagaggcggcgaggcgcgggcggtgaggacggacagtcaccgacttagtccagttccctgtgatctcaaaacaattgttgcagcaggctcctggcagtctcaagcagttcatcttcttggtgtactggtttcctattgtgattttatcatggaaaatcaattggctaaatcaactgaagaacgaacatttcagtaccaggattctcttccatcactgcctgttccttcacttgaagaatcattaaaaaaataccttgaatcagtgaaaccatttgcaaatcaagaagaatataagaaaactgaagaaatagttcaaaaatttcaaagtgggattggagaaaaattgcaccagaaattgcttgaaagagcaaaaggaaaaagaaattggctggaagagtggtggctgaatgttgcctatctggatgttcgtataccatcacaattgaatgtcaactttgcgggtcctgcagctcattttgaacactactggcctccaaaggaagggactcaattagaaagaggaagtataactctttggcataacttgaactactggcagctattaagaaaagaaaaagtgcctgttcataaagttggaaatactcctctagatatgaatcaattccgaatgctattttctacctgcaaggttccaggaattactagagactccattatgaattattttaggactgagagtgaagggcgttccccaaaccacattgtagtgctgtgtcgaggccgagcttttgtctttgatgtaatacatgaaggatgtttggtcaccccgccagagcttctcagacaactgacatatatccacaagaagtgccatagtgaacctgatggacctgggattgcagcattaactagtgaggagcgaactcgatgggctaaggcacgagaatatctgattggtcttgatccagagaacttggctttgttagaaaaaattcagagtagtttactggtatattccatggaggatagcagtccacatgtaacaccagaggattattctgagattattgcagccatccttattggagatccaacagtacgctggggtgacaaatcctataacttgatttccttttctaatggagtatttggctgtaattgtgatcatgctccttttgatgcaatgattatggtgaacatcagttattatgtggatgagaaaatttttcagaatgaaggaagatggaagggttcagagaaggtacgagatataccacttccagaagagctcattttcattgtggatgagaaagttttaaatgacatcaaccaagctaaagcccagtatctcagggaggcatctgatctacagattgcggcttatgcctttacatcttttggcaaaaagctaaccaagaacaagatgcttcacccggatacgtttattcagcttgcacttcagctggcctattacagacttcatggacaccctggttgttgctatgaaacagctatgacaagacatttttatcatggccgtacagagactatgcgatcatgcacagttgaagcagtgaggtggtgccagtccatgcaggatccttctgtcaatcttcgtgagcggcagcaaaagatgttacaagcttttgcaaagcataataaaatgatgaaagattgttcagctggaaaaggatttgatcgtcaccttttaggtctcttactcatagcaaaagaggaaggtcttcctgttccagaactctttacggacccacttttttccaaaagcggaggaggtggaaattttgttctctcaacaagtctggttggctatttacgagtccagggagtggtagttcccatggtacacaatggttatggatttttctaccatatcagagatgacaggtttgttgtggcctgttcagcctggaaatcctgtcccgagactgatgcggaaaagctagttcagctgactttttgtgcttttcatgatatgatacagctgatgaactctactcatctttagagatgaatcatctattaagcacttaccaaaacatatcattaaactgagtgctgggagtgagttggtaatatgagatgggaaggaatgttgacttgctaacattcctttaacaagttaagaaaacttgttaaatgtagaaattagtagaatcatgctctctaaatttattctgccatagaaggtagaaatatttttaagctcctctgatgcagcagcaatgcaaattatgacatagtgaatatagaactatgcagtatttaagcctcaacaatccaaatctacaaactttaacaatgcaagtcttactctaatttttaagtatttttgttggtacttacatgggttataaatcctctctctggacatcaatgtagagtccatctttcaagcactttaatttttttagctgccaaagggtatgaattacattattgtatgctaatttccctgaaatcaatgccttctatgttcaccacagggatacaagcctgttatgtttgatgggaaagaccactacaatctaatggtgatctaaaataacttttttgggctgggtgcagtggctcatgcctataatcttagcactttgggaggccaaggtaggaggattgcttgaagctaggagtttgagaccagcctgggcaacagggtaaggtcctgtctctacaagatcaaaaacttagccgggtatggtggtgcatgtgtgcctgtagtccaagctacttgaaggctgagacaggaggatcggttgagcccaggaggttgtggctgcagtgagctgtgatgtgcccttatgctatagcctgggcaagagcgtgagaccctgtctcaaagaagaaaaaaagagaaaaataactcttttgaacaaacagacaaattagctagtagtatggagatgtataccctctattacacacataaaaccgtaacaaaattcattgtggtgtattataattagttttgtgaatagaaaaataaagcacttatgtttaaatttgttacagtgacttttaaaggattaatgttgaatcacattgtcagaattttttcctcctcgctgttcaattttgtagtttttactctcaaaaaatgaaattctcaaaattatatagctttttgttttgtttgaataaatgattcattcctgtttg

SEQ ID NO: 1033 - DNA, 3347 bp, Homo sapiens
gctatttgacgtgcggctcgaggaaggcgaaggtttttgtgttgctagccggggccagcggcggtggcggcggcggcggaggcgtcggtggaggaggggaggcggcgaggaggcgcagctcccgctgcaccgcgatcgacgctgcggagcgagcccacccgccccgggagctcgcctccccggtgctcccccgccctccccgcccccccagcggcgctgcctcctccaaatgagcgattcgcccgctggatctaacccaaggacacccgaaagcagcggcagcggcagcggcggcggcgggaagaggccggcggtgccggcagcggtgtccctcttgccaccggcggaccccctgcgccaggcgaaccggctcccgatcagggtcctgaagatgctgagcgctcacaccggtcacctcctgcacccggagtacctgcagccgctgtcctccactcccgtcagccccattgagctggacgccaagaagagccccttggcgctgctggctcagacctgctcgcagatcggcaagccggacccgccgccctcctccaaactcaactcggtggcggcggcggccaacgggctgggagcggagaaggaccccggccgctcagccccgggcgccgcctccgcagccgcggccctgaagcagctgggggactcaccggccgaggacaagtccagcttcaagccctactccaagggctccggcggcggcgactcccgcaaagacagcggctcctcctcggtgtcttccacctcctcctcgtcctcctcgtccccgggagacaaggcgggcttcagggtccccagcgccgcctgcccgccctttcccccgcatggagcgccggtctccgcatcctcgtcctcgtcgtcgcccggcggctcccgcggcggctccccgcaccactctgactgcaagaacggcggcggggttggcggcggggagctggacaagaaagaccaggagcccaagcccagcccggagccggcagccgtgagccgcggcggcggtggggagcccggggcgcacggtggcgccgagtccggggcctccgggcgcaagtccgagccgccctcggcgctggtgggggccggccacgtggcgccggtgtctccctacaagccgggccactcggtgttcccgctgccgccctccagcattggctaccacggctccatcgtgggcgcctacgccggctacccgtctcagttcgtgcctggcctggatcctagcaagtccggcctcgtgggaggccagctgtctgggggcctgggcctgccgccgggcaagccccccagctccagcccgctcaccggggcctccccgccctccttcctgcagggattatgccgcgacccctattgcttgggaggttaccacggcgcctcgcacctcggcggctccagctgctccacctgcagcgcgcacgaccctgccgggcccagcctgaaggcggggggctacccgctggtgtaccccgggcacccgctgcagcccgccgcgctctcgtccagcgccgcccaggccgcgctccccggccacccgctctacacctacggcttcatgctgcagaacgaaccgctgccgcacagctgcaactgggtggcagccagtgggccgtgcgacaagcgcttcgccacctcggaggagctgctcagccacctacggacccacacggccctgccgggagccgagaaacttctggccgcctaccccggggcctcgggcctgggcagcgccgccgccgccgccgccgccgccgcctcctgccatctgcacctccccccgcccgccgcccccggcagccccgggtcgctgtccttgcggaatccacacactttgggcctaagccggtaccacccctatggcaagagccacttatccacagcggggggcctggccgtgccgtccctccccacagccggaccctactattcgccatacgcgctgtatggacagagactagcttcagcctcggcgctgggataccagtaactacagctcttcctccaccccagccccctcaccctcctccctctccctcctcctccctccccacctgccgtcgccgctgcaacctccactactgcttgaccctgccgggattccccacccagcccttccccaccggactgtgtatttatttactataatgttagcttacaagctgggaatataagtgcattaacggcccacatgagtcaatggtatgcaaaaagtctgtgttctcccaaataataatattaatcccacaaataacgacatgatccccgcccctgttcctttctgttattttttcttagatataagttttacattttttattccttttcctctttttttggttttgattggtttggtttgagggagagttggggtctttgggttcttctagacgttttgttttcccttcctggggagtttcttgcatgagtcttaacttaaaactacgtttccgccttctctttttccctcttcccccttcattccctcttgtttccttccatttgcggttctgtttttgttttttgttttgttttgttttgttttttcctttgttgtacaagtaacagagaggaggttttttttgtaactcattttgggggtggagggggccacctgggtggcaggggccctggagctctattgacctggtacactgctccgggactcctcccccgccaccctccgcgcatagggtccttggtctggaccctgccccccaaaagtagggccttgctcctctaccttgctctgagcacggagagccctgaccccaccagtaggctcgcccccagaagggcccaagtggccgtctaccgtcaccttccagactcccgcccctaacacccagtggctacagtgcgcctgtcggggcacctggagcgctcacctggttgaattcaaagtcccagaaggccccgctggcgtgaagccggccccttacattttgcgaagtgcattatagtccttgtttttctctccctcgtgggggcaacgacccctcccctggcagtaggggtggggtaggtgactctcgctagatccctccaaagcagaccggtggcgatgtcagcggatgtcacgagctcgttagctgcgttcggggaaggttggggcgtcagggagctctcggatcacagcagcccccgccctctcctaggcctggcccggcagagcccccagagtggaccccccagcgactggggtcttctccccactcctccctccttctggtctgatgcggcagcgcgggggctgcggggcctgtttgggacgaacagagctctcccttggtaagacttattttgttaataaatggaatacttggctatattca

SEQ ID NO: 1034 - DNA, 2789 bp, Homo sapiens
aggctaggcgtggacccaactggcgaggctgctggggttgcagcgggacagttggggcggccccgcaggcccaggtttttgaaaataaagttaattcagagaaggtaaaactttctcttcggaatttcccacataatgattatgaggatgtttttgaagagccttcagaaagtggcagtgatcccagcatgtggacagccagaggccccttcagaagagacaggtggagcagtgaggatgaggaggctgcagggccatcacaggctctctcccctctactttctgatacgcgcaaaattgtttctgaaggagaactagatcagttggctcagattcggccattaatattcaattttcatgagcagacagccatcaaggattgtttgaaaatccttgaggaaaaaacagcagcgtatgatatcatgcaggaatttatggctttagaacttaagaatctgcctggtgagttcaactctgggaatcaaccaagcaacagagaaaaaaatagataccgagatattcttccatatgattcaacacgcgttcctcttggaaaaagcaaggactacatcaatgctagttatattagaatagtcaattgtggagaagagtatttttatatcgctactcaaggaccactgctgagcaccatagatgacttttggcaaatggtgttggaaaataattcaaatgttattgccatgataaccagagagatagaaggtggaattatcaaatgctaccattactggcccatttctctgaagaagccattggaattgaaacacttccgtgtattcctggagaactaccagatacttcaatatttcatcattcgaatgtttcaagttgtggagaagtccacgggaactagtcactctgtaaaacagttgcagttcaccaagtggccagaccatggcactcctgcctcagcagatagcttcataaaatatattcgttatgcaaggaagagccaccttacaggacccatggttgttcactgcagtgccggcataggccggacaggggtgttcctatgtgtggatgtcgtgttctgtgccatcgtaaagaactgttcattcaacatcatggatatagtggcccaaatgagagaacaacgttctggcatggttcaaacgaaggagcagtatcacttttgttacgatattgtgcttgaagttcttcggaaacttctgactttggattaagaaagacttctgttgcctctcacttgaaattaccaagtgggtttgcacctcctcataaagaacatgtttgcactgtgctgaagggctttgctatgcatacaatctgctttcttggtttatcagtttattttctttctaaaagctccctgaagggcaatatcatttggcttggggtgatcagtgtttacttattgatcttgctagacaatatcaaaataacttcccacattttccagtgaaacagatgttacataaaacgattgcagcttggctatttggttgaagggattacagagcccaataaaggatttaaaatatattcattaagattttatttggaaaggtggctggagagagctgaggatttccaggactttgtaagttcttattctgggagaacataaggccaataatcatgacctcttccaggcatttttaagacagatgtctattcatgttctttagctagagcctgtactttttgctggcatttgaataacccagtttaaaaagagtccagttagggtggactaactttggacacaaattggcttccatttcctacattttcatactgctgccttcctacagctgctagaccaagacctgttggtctgggaagcatttcatggatagggagagctcctctcggtgaacagtccaaaactaaaatagatgtttatatagaaagcccaagaggagacttttgccatgcctgagttctttcctatcccaccctaacacttaacatattacttagtctgctttgttaaaagcaagtattacctttaacttgcctcttactctttgccctttagctaactaataaagtttgatataggcattattatataattctgagtcattcatggtatctctcatgtttgatgtatttttcaaactaagatctatgatagttttttttccagagttccattaaatcatttatttcctttactttctcacctctgttgaaacatttagaaactggatttgggaacccaattttggaaaaccagattcatagtcatgaaaatggaaacttccatattctgtttttgaaaagatgtggccattattacagtaattttattataggactttgcctcgtacaattaatagtgatattttggacaaggagttctggtgacaagctatacctaattataagctataaaacaatagatatgagtgtttgtacagtttaactcaatggagatcagaatattctatgtattgagaaaatgtttaatatcaatctataaatcttgaatttctaagaggcttattttgttcttttggctgaatgagtatatttgaattggttgaataattaataattctcattgtaaaaataattatatgccaaaaatatatttgatgttaaatcaaatagatgattctgtttacattgttcatatgaataataatctgtgttaatttcattttgataattggcctttaatatttgtatctctaattttattttctctctgttactgtaaaataatagctataatgtataacaattttcttcagaagaattctatgctattattaaaataaaatatttactgtgta

SEQ ID NO: 1035 - DNA, 3670 bp, Homo sapiens
gtggtcttcccgcgcctgaggcggcggcggcaggagctgaggggagttgtagggaactgaggggagctgctgtgtcccccgcctcctcctccccatttccgcgctcccgggaccatgtccgcgctggcgggtgaagatgtctggaggtgtccaggctgtggggaccacattgctccaagccagatatggtacaggactgtcaacgaaacctggcacggctcttgcttccggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctcctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcaaaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaacataactggcaa

SEQ ID NO: 1036 - DNA, 837 bp, Homo sapiens
gccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactc

SEQ ID NO: 1037 - DNA, 2573 bp, Homo sapiens
cacgccggcgctccaggcgcggcaggctgccgcccccggaagtagtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcaggtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaa

SEQ ID NO: 1038 - DNA, 2056 bp, Homo sapiens
caggatgtaccaaacgtggaagcggagacggggaggtctgggggtgccacgcaagtccctttcctcccgacacgagtgcagtaaagaaaaacggttatgagcgtaaagtgacagcctcggccgatgggaatagggggaagtccgacactgagcaacgaacgcattcccgcgcctccaaaacctaggccgggggcgctggaaacccttaccggcacccggccaccgcggcagacgcttgctcctgccacgccccccccccctcccccgcatcacgtgtctgcactcgctttcctcggattcccggatgtggttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcactatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagac

SEQ ID NO: 1039 - DNA, 4699 bp, Homo sapiens
gggaccaagagcggaagtgggtgtgacggggacgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggcccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcccgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcatgatggaggg

SEQ ID NO: 1040 - DNA, 3390 bp, Homo sapiens
agaaggggaaacaggaatcgattaggaataaaggattataatccactttccttctgaggaaaagctgggaaccttctcattttgccttatgaaaactaagctgaatcgactgctgccaaacatctattaggcaaaattggcctcttgcccatgatttgactttccagcacagccagttctttttctcctctgcagctgattggctctggagtgtggccagaagcctctctcctgcaattaaaggagtcgggtctctaactgttgatctgtttttttcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgagaccgggaggggctttctatttcatggagcatgtggcagctgagtgttcgacttggaattacttctggcaacaagtcctggatcctgcctggcaccttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttaagagctgaatggctcaaagaatttaaagcttcagttttacatttaaaatgctaagtgggagaagagaaaccttttttttggggggcggtttttttggtttgttgttggttttttttttttttttggcgggaagaaagagttttgctcttgttgcccaggctggagtgcaatgacgtgatctccgctcactgcaacctccacctcgcgggtttaagcgattcttctgcctcagcctccctagtagctgggattacaggtgcccaccaccatgcccagctaatttgtatttttagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgagacggagttttcgctcttgttgcccaggctggagtgcaatgctgtgatctcagcttaccacaacctccacctcccgggttcaagtgattcacctgcctcagcctcctgagtagctggtattacaggcatgcgtcaccacgccggctaattttgtacttttagtagagatggtgtttccccacgttggtcagtctggtctcaaattcctgacctcaggtgatctgcctgcctcggcctcccaaagtgctgtgattacagacgtcagccaccatgcctggcctgaaaccttttttaggtaaagttgaattccatccttaaaagtttctgttatatcctatttagccattttctattgtctcccaaagaattcacatcaaaaaaacagctttgaactcccccttcaaaggaaacagtcgactttcataattagcatctaccattatccccaaatcttattttattcattgacttgaaattttttccaattgcttttttttttttttttttaaggttaagagcagaggtttactaggccaaagaaagagaatagctctctgttgcagagaggggtcctggagaaatgggttaccccagttgtcttatttaaatggttacccatcagattttaattttatcttctctttgagagcttggtaataagaagcacttaaatcactccaaagaagactttaaaaagggagcagtgaaaaggtcttaataatttattgattgaattaagaaatactagctaattaagaatctgagtctaaacagcacagattttttctttctgcttttaaattgtgttttaaaaaaagagacagggggctgggcgtggtggctcacgcctgtaatcctagcactttgggaggccgaggcgggtggatcacgaggtaggagttaaagaccagcctggccaacatggcaaaaccctactaaagatacaaaaaaaaaaaaaaattagccaggcgtggtggtgggtgcctgtaatcccaggtacttggaaggctgaggcaggagaatctcttgaacccagaaggcgaaggttgcagtgaaccgagatcatgccattgtactctagcctgggtgacaagagcaagactccgtctcaaaaaaaaaaaaaaaaaaaaaaagaagtagagacagggagacagggtctcactgtgttgcctaggccggtcttgaactcctgggctcaagtgattctcccaccttgacctcctaaattgttgggattacaggtgtgagacagtgcacctggccgaaatagctcaagtttctgaaaaacaaatctgaatctatttgttattcttagcgtcactggtctggctttcagaattaacatacaaggttgccacacctagttctgcccagctttatgtcttttattccagtattccaccaaagtttgttttcctgcattccagttctcaagtcttaagataaagattgtacttgacagtttagtatatccataaaactatttgaggtggttaaggttcttgggttcattttccttaatactttgctgaatattgtagattgtaggcaatgaaaaagtctactaaattaggaaaaccttgaataattaggtatcctaggtaagagcccctaaacatcaagcaatctgtgagtctgtaaagaaataaatattttttggattattcttatctaattccacccctgttggaagatgatttctttgttctttgcaactatggaagctgtgaaaatcatcacaagtgcctctgaaagcgagtgttaggttggttagagggtttaatattttctgcaatggtttgtaggaattttaataaatgtagtatattttctgagatgattttgtaaaagtactattttaaatatcaaatcaaccaataaattcacatttgtgttaggaacagaaatatggttta

SEQ ID NO: 1041 - DNA, 5812 bp, Homo sapiens
aagtcacgtgctgtgacagtagctggggtgaggccgtcgtcgccgcacgggctggttggggctgtgtctgtgggaggcgccggggtgatggcggtggagactctgtccccggactgggagtttgaccgcgttgacgacggctcgcagaaaattcatgccgaagtccaacttaagaattatgggaaatttcttgaggagtatacctctcaactgagaagaattgaggacgctctggatgactcaattggagatgtttgggatttcaatcttgatcctatagcattaaagcttttgccttatgaacagtcctctcttttggaactcataaagactgaaaacaaggtcttaaacaaagtcatcactgtttatgctgcactttgttgtgaaatcaagaaattaaaatatgaggctgaaactaaattttacaatggtctcttgttttatggagaaggagctacagatgccagcatggtggaaggtgattgccaaattcaaatggggagatttatttcattcttacaggaactgtcttgctttgttacgaggtgctatgaagtggtgatgaacgtagtccaccagttggctgccctctatatcagtaacaagattgcacccaaaattatagagacaactggagttcattttcagactatgtatgagcacttgggagaactgctaacagttttgctcaccctggatgaaattattgataatcatatcacactgaaagaccactggactatgtacaaaaggttactgaaatctgtccatcacaatccttcaaaatttggaattcaggaagaaaaattaaagccatttgaaaagttcttgctgaagctagaagggcaattactggatggaatgatattccaggcctgtatagaacaacaatttgattctctcaatggaggagtatctgtgtcaaaaaatagtacttttgctgaggaatttgcacatagtattcggtcaatttttgcaaatgtagaagccaaacttggagaaccttctgaaattgaccagagagacaagtatgttggaatttgtggactctttgtattgcactttcagatttttcgaactattgataaaaagttttataagtctttattggacatttgtaagaaggtaccagccatcactctaactgctaatattatttggtttcctgataattttctgatccagaaaataccagcagctgccaaactgctagacagaaaaagtcttcaagccattaaaatacacagggatacttttctacaacagaaagctcaatcacttaccaaagatgtacagtcttactacgtctttgtgagctcatggatgatgaaaatggaatctattttgtctaaagagcagagaatggataaatttgctgaagatctcaccaatagatgtaatgtttttatacagggcttcttgtatgcatatagtattagtaccattattaaaaccacaatgaatctctacatgtccatgcaaaagccaatgaccaaaacctcagttaaggcattgtgcaggcttgttgaacttctcaaggcaatagagcatatgttctacaggagaagcatggttgtggctgattcagtttcacatataacacagcaccttcaacatcaggctcttcattctatttctgtggccaagaaaagagtgatttctgacaaaaaatacagcgaacagcgtcttgatgtgctctctgctctagttttggctgaaaacactctaaatggaccaagcacaaagcaacggcgacttattgtttctttggcactaagtgttggcacacaaatgaaaacatttaaagatgaagaactctttccacttcaagtagtcatgaaaaaactggatcttattagtgaacttagagaacgagtccaaacacaatgtgactgttgttttttatactggcatcgagctgtcttcccaatttatttagatgatgtatatgaaaatgctgttgatgcagccagattacattacatgttcagtgctttgcgcgactgtgtacctgctatgatgcatgcaaggcatttagagtcctatgagatacttctggattgctatgacaaggaaattatggaaattttaaatgagcatttgctggacaaattatgcaaagaaatagagaaagatctgcgactttctgtgcatactcatttaaagctggatgaccgaaaccctttcaaagttggcatgaaagacctggctctttttttctctctgaatccaattcggtttttcaatcgtttcattgacattcgggcttacgtaactcactacctagacaagactttctacaatctaacaactgtagcccttcatgactgggccacttatagtgagatgagaaacttagctactcagcgttatggactggttatgacagaggcacatcttcccagtcagactttggaacagggccttgatgttttagaaattatgagaaacattcatatatttgtgtcccgatacctctataatctcaacaatcagatttttattgaacgaacaagcaataacaagcatttgaatactattaatattcggcatattgctaattcaattcgaacacatggcacgggaattatgaatacaactgttaatttcacctaccagtttttgaaaaagaagttctatatatttagccaatttatgtatgatgaacacatcaaatccagattgattaaagatattcgatttttcagggaaattaaggaccaaaatgatcataagtatccttttgatagagcagaaaaattcaatcgaggcatcagaaaacttggagtaacacctgagggacagagctaccttgatcaattcaggcaactcatcagccagattggtaatgctatgggctatgtacgaatgataagatctggtggtcttcattgtagcagcaatgccattagatttgttcctgatcttgaagatattgtaaattttgaagaactagtaaaagaagaaggtcttgcagaagaaacattaaaagcagcaaggcatttggattcagtcctcagtgatcacacacgaaattctgccgaaggcacagaatatttcaaaatgcttgtagacgtttttgctccagaatttcgaaggccaaagaatatacatctccgaaatttctatataattgttccccctctgaccctcaactttgtagagcattccattagttgcaaggaaaaattaaataaaaaaaataaaattggagctgcctttactgatgatggctttgccatgggtgtggcttacattctaaagcttttggatcagtatcgggagtttgattcacttcactggttccagtctgttagagagaaatacctgaaggagataagagcagttgctaagcaacagaatgtacagtcagccagtcaagatgaaaaactcttacaaaccatgaatctcactcagaagcgactggatgtctatctacaggaatttgaattgctgtatttctcactgagcagtgcaagaattttcttcagagcagacaagactgcggctgaagaaaaccaagaaaagaaagagaaggaagaagaaactaaaacaagcaatggagacctgtctgacagcactgtgtctgctgatcctgttgtgaaatgatacggatggtattcactgcacatatgatgaaatcatcagaattgttaaaacttttgccagtggaatggataaactattgatgaattgtttcctgggtcacatctctggaaaatagatgttacagttcttaaaggcagtgctttaaagtgaagttcattctgtttccaaaggctctactttcaaaggttaagaatgagattttaaaattggatttttgcctggacttgagggtacaagatgtttctatttgaagtgaagttataaaagggcaaatccagattcataaactatcacctcggatttcttgtaatctacatgtttgtaatttgtatttgcatagatctttgatctatagttatttcaagtcatgggaaattcaatgcatatactatatacagccagtaaatacatgcttaacaaaaggaatgagcctgaagttcataaagaatacatatcaatattcttataaaaggaatatatgaagatggctttgatactagaggtgaggcacaagtgttttatgtactctcagtgtacagtataactgatgatccttctttcattgttaatttcatgtgactcacaagagctgctgatgtctttgatgagacattttataactagtttacattgctttgagaacatttaacctccaacagctgctttaaatttaagatttacttaatactcagaaaattcagataaagccatagagtcctgtttgaagcttcacttctattttggttgaaggcatgatgtatgatgtcagaaaaaaaattgaatgaattatttctacatccaaactcaggtttcttctacattagattgaattgaaattttggtgatggtttgggtagactttttttttatatcaagtataatttaaaacatcagattaaataattacactgttcaggcttttaaaaaaataccactgtgagaataaagcgctagcaagatacatcacttactgattttaaaaatacagaaagattttgagtaaattttgtgcccagcaagctgttagttttatttttgtaaaggtatgtaagttattaaatggttaatcatggccttttaaaaataaaataaagtgatacctttacaatgaagacaaaagtttaaaactttctaatacaaacaccattttgggaaatgcttgatttttttctattgcatttgtctgctaaacatttctttggataaatcctgcaaatacttctaacattattctttgattccagcttttagaatgggtgtacaatgccctgtttgtacttactggttagggtcagggtaacttgccagcccaagataaatactttaattgttaaaagtcagaagagacagaatatgtaggaaatgttttttgtttattatgtaaacatggcttacagaattatgaacagtggatagattaaaggcatttaatatttgtaattcataataactgtagaaatggccctaaagcatgctgcataattaataatttatattttcattattataagtgtttatattaatgatcttgcatttgattatatcaaattcgtcatttcatagcaacagtattgttttctctgtttttcttctctaacttctctgaaatcatctcctattaagggatagaaattgttactagaagagaatcacatgttctgtgttcattatccctacacatgtaaattaattattttatcaatactagatagagttcacatgctgactccctggatacctacagttgagaagaaaatgacagacaattatttttcctttaggtcaaaataatgtcactgctatctggataaattataagttcatatatttgaaataagatcctggaaacgaatttaaatggtgtcaaactgcagagcaacagggcttcagtatattcacatctaataggttaatatgtacatttggatgatgatttttcttgataacattaacattaattttattttttcagacatactgtaatttaaaaattaatgtgagcgtttgttttaagttcacagaaaacttaataattcaaattctcaggaattaaggactcaccataacattgtcagttctaatgaaattttgtaaaagatggcaagtttgttacctcacttgagtggggttttccttttcccccaattctaagagaatataatgtgtatactaaaacattaataaacataattttgaaaatttc

SEQ ID NO: 1042 - DNA, 1737 bp, Homo sapiens
acctgagctgagactagtgcccctgtggaggggtagtgtgggagggcccccagggtgacacttggaggcaaaggctggttctgggcagagtcacagtgagctgggcagaagcctcgcctgaggatcccgtggccccaatttgtgtgcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctc

SEQ ID NO: 1043 - DNA, 3484 bp, Homo sapiens
gcctactttggtgcagaggcgtggggggcgggacgcgtctttcccgttcggatcgcggggaaagcagtggctccaagtgagccagaggagagctgaggagaggagggggaggccgacgacctgggccctgggcctctgaaggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggca

SEQ ID NO: 1044 - DNA, 3504 bp, Homo sapiens
tgctgcctcagcctcccgagtagctgggactacaggtgcccgccaccacgcccggctaattttttgtatttttagtagagatagggtttcactgtgttagccaggatggtctccatctcctgacctcatgatctacccgcctcagcctgccaaagtgctgggattacaggcgtgagccaccgcgcccggccaaagcggtttttaaagggaggatttggaaggcaaaagaggcagggggactgggaggtgtcaggtggtgtgaccccctccagtggcttgtcctgaattatttttccatctgtggaagtggccggcgtcatcatggctggaggaggtgcatggttcgtatcaggatctgactactgaagcttctaaggaaatatgtgaccagataaggtcatcaccttcaggaccacaatgcctggtagggcaaggactcgcgcccgaggcagagcccgccgcagggagagctaccaacaagaggcacctgggggacccagagcacctggatcagctacaacccaggagccccctcagttgcagtcgacaccccggccgctgcaggaggaagtcccagtggttagacctctgcagccaagagcagcaagaggaggagcaggaggaggagcacagtctcaaggggtgaaggaacctggacctgaggctgggttgcatacagcgcccttgcaggagagaaggattggtggagtttttcaagacctggtggtgaacaccaggcaagatatgaagcatgttaaagactcaaaaacaggttcagagggtacagtggtacagctactcgccaaccacttccgagtgatatctcgtcctcagtgggttgcatataaatacaacgttgactacaaaccagacatagaagatggaaatctccgtacaattttacttgatcaacatagaaggaaatttggagagcgccatatatttgatggaaactctttattattatctcggccactaaaagagcggagagtggaatggttgagcacaaccaaagacaaaaacatcgtgaagattacagttgagttttccaaagaactcacgcccacgtcgccagattgcctacgctattacaacattctctttagaagaactttcaagctgctggattttgaacaagttggtcgcaactattataccaaaaagaaggccattcagttataccgtcatggtaccagtttggaaatctggcttggttatgttacttctgttcttcaatacgaaaacagcattaccctctgtgccgatgtgagccacaaactgctccgaatagaaactgcttatgatttcataaagagaacatctgcccaggcccagacaggaaacatccgagaggaagtaactaataaattaattggatcaattgttctgacaaaatacaacaacaaaacctacagagtagatgatattgattggaagcagaatcctgaagacacatttaacaaatcagatggcagcaaaatcacctatatagactactacaggcagcaacataaagaaattgtcacagtgaagaaacagccacttttggtcagccagggcagatggaaaaagggcctaacgggtacacaacgtgaacctatcctgctgattcctcagctgtgccacatgacaggtctaacagatgaaatatgtaaagattatagcattgtgaaagaattggctaaacatacaagattgagtccaagaagaaggcatcatacattaaaagaattcatcaatactctacaagataataaaaaagtacgagagttacttcaactctgggatttgaaatttgataccaattttttgtccgtcccgggaagagttttgaaaaacgcaaacatcgtgcaaggcagaagaatggttaaagccaattcacaaggagactggtcaagagaaataagagaattacccttacttaatgcaatgccactacatagttggctcatactctatagcaggagcagtcacagagaagccatgtccttaaagggtcatctacagagtgtcacagcccccatgggcataactatgaaaccagcagaaatgattgaagtagatggtgatgctaactcctatatagacacattacggaaatatactagaccaacactgcagatgggaatgtcatgtttgctggttttcaaggtgatttgtatcctgcccaatgatgacaaacgtagatatgacagcataaaaagatacctatgtaccaaatgcccaattccaagccagtgtgtggtgaaaaagaccttagaaaaagtccaggcaaggaccatcgtcaccaagattgcccagcagatgaattgcaagatgggaggagccctctggaaggtggagacagacgtacaaagaacaatgttcgttggcattgattgtttccacgatatcgtaaatcgacagaaatcaatagcaggatttgttgcaagtaccaatgctgaattaacaaagtggtactctcaatgtgtcatccagaaaacaggagaagagcttgtgaaagagctggagatctgcttgaaagctgccctggatgtctggtgtaaaaacgaatcatcgatgccacattctgttattgtgtatcgggatggagtgggagatggtcagcttcaagcattgcttgaccatgaagcgaaaaagatgtcgacctacttaaaaaccatctctcctaacaatttcactctagctttcattgtggtgaagaaacgaataaacactagattttttcttaaacatggaagcaattttcaaaatccacctccaggaacagttattgatgtagagttgactaggaatgaatggtatgacttttttattgtgagtcagtctgtgcaagatgggactgttacccccactcattataacgtcatctatgacacgattggcttgagcccagatacagtacagcgtttaacatattgtctatgccacatgtattataatttgccaggcatcatccgagttccagcgccttgccactatgcccacaagctggcttacctcgtggggcagtccattcaccaggaaccgaatcgttccttgtcaactcgtctcttttacctttgacctgcagaagaagacctgatgtgctaatgaaaccacaacgtgtaagcctgtcttccttttgaagcaggatgtctgaaatattttcctaggtccatagcattaaattctcatcgtttttgattggacacaggagagattcagagtgatatgttctactctcaatactaccacagactgatttttccagagaggagaactgacagggtttggcttgcagtttccctttcaaatatgtgacagagatctcacagctgaacgtgactgaacattttccaccccaagcagggccactctaagaattgaaaagatggggcattcgtcacagagagagtacatctgtgaacaagtaaactctacttggaaaactacgtttactttatttttgaaacttttttttgttaaaggacaggaaaggaagacataaaagtaacaacactg

SEQ ID NO: 1045 - DNA, 2529 bp, Homo sapiens
atccctctcagctcttgctaagtgatcactagcttgcctccaagctctctcactatgaacagacaagtttgcaagaaatccttcagtggcaggagccagggtttctctggccgctctgctgtggtctccggcagcagcaggatgagctgtgtggcccgctctgggggagctggtggaggggcctgtggcttcaggagcggagcaggcagctttggcagtcgcagcctctacaacctgggcagcaacaagagcatctccatcagcgtggcagctggcagctcccgggctggaggctttgggggagggcggagcagctgtggctttgcaggtggctatggaggtggctttgggggcagctatggtggtggctttggtggtggcagaggagtaggtagtggttttggaggggctggtggctttggtggagctggtggctttggtggtcctggtgtatttggtgggcctggcagctttggtggtcctggtggctttggccctgggggctttcctgggggaattcaggaagtgattgtaaaccagagtctcctgcagcccctcaatgtggagatcgacccccagattgggcaagtaaaggcccaggagcgggaacagatcaagaccctcaacaacaagtttgcctccttcatcgacaaggtgcggttcctggaacagcagaacaaggtcctggagaccaagtgggaactgctccagcagcagaccacaggctcagggcccagcagcctggagccttgttttgaatcctacatcagcttcctatgcaagcagctagattcacttctaggggagagggggaacctggagggagagctgaaaagcatgcaggacctggtggaagacttcaaaaagaagtatgaagatgaaatcaacaaacgcactgccgcagagaatgagtttgtggggctcaagaaggatgtggatgcggctttcatgaacaaggtggagctgcaggccaaagtggacagcctgacagatgaagtcagcttcctgaggaccctctatgagatggagctgtcccagatgcaaagccatgccagtgacacgtctgtggttctgtccatggacaacaaccgctgcctggacctgggcagcatcattgccgaggtccgcgcccagtatgaggagattgcccagaggagcaagtctgaagctgaggccctgtaccagaccaagcttggggagctgcagaccacagctggcaggcatggggatgacctgaggaacaccaagagtgagatcatggagctcaacaggatgatccagaggctacgggctgagattgaaaatgtcaagaagcagaatgccaacctgcagacggcaattgcagaggctgagcagcgtggagagatggccctcaaggacgccaatgccaagctccaagacttgcagactgccctacagaaggctaaggatgacctggctcggctcctgcgtgactaccaggagctgatgaacgtcaagctggccctggatgtggagattgccacctaccgcaagctgctggagggagaggagtgcaggatgtctggagaatgtcagagtgccgtgtgcatttcagtggtcagcaatgtcaccagcacaagtggcagctctggcagtagccgtggagtttttggaggggtcagtggcagtggcagtggtggctacaaaggcggcagcagcagcagcagcagcagtggctatggagtcagtggcggcagcggcagtggctatggaggggtcagcagtggcagcactgggggcaggggtagcagcgggagctaccagagcagcagtagtgggagcaggctcggcggtgcaggtagcatctccgtgagccacagtggaatgggctccagctctggcagcatccagacttctggaggaagtggctacaagtctggtggtggaggcagcaccagtatccgcttctcccagaccacgagctcaagccagcatagctccaccaagtgatctactgttccaaatctctataaccacctgcttcccactcagcctgcaatagtgtttcccactctctgcttggcatcaatagatgcataagggtcaaccacatttttcctcaagttccctggagaagaagctgaactcctggtttctccatccccatgaccttcccagggccatggaggtcctgctgctggtctgggatgatgatgcccctggaaaccttcctgcaatggccccttactttggacagcaacccctgagcccaagccagttttggccttcacagcctggcctgttcccactctggcccatctccctttcttactgggagttggagatttgaagccagtcatctcagcactgtctgaggagggcagagccatgggttctgtgctggagggtgcacggccaagatctccagactgctggttcccagggaaccctccctacatctgggcttcagatcctgactcccttctgtcccctaattccctgagctgtagatcctctggtgatgagtatgttgcactttcttttctcaataaattgcactgaacttca

SEQ ID NO: 1046 - DNA, 4785 bp, Homo sapiens
acctgcttccctctcggatagccagggctgatgatttcaactcattaatcattccgaactcttcccaacaaacagcctcatggctgtcccggacctcctctgtcccggctcaggaaatgatctcggtcggaagtgaaaagaccaaatcggccccaggaggccattttcttcgacagaagctgaggcgtgggggcgtggccttcccccgcttccccctccactcccccgcccgcccccggccccggctttccgatctcggcccagggaagagccttggtcgcgaatcaccagtttgcatttgcccctggggcgggggcggctttctgagaccaggctggggctgggactccgccaccttcagctaagggtaccgaggtcagtccgggagtcgcgtcaccgggactcgaacccgcctcttcgtcttccgaggcctagtgcgagcctgcggcgctaaacgcagtcacactgtccctttaaggcggcactttttattcttcatttgtttacttcttcatgcgctcttcggtctttacaaaatgtgctcgcgatatccttccgcaagtgtcagtctcaggcactcaccacccgccttgaagccatttctataatcttaagactcgcgagttagcagccgtgggccgacgtctctctttataggatttaattcttttacattttagggactactttttaggaataaaccattcttgcgttagttaataaaggttcataaccttcggaacccctccgctgagaacaaaatacgataatagcctttataacgcaccttttcataaaaatattctgtgaggactctcataggccatcgaatcttctcgtattcctgaaacagaatggtacggtccagaacccgccccatcttctctgcgattggccgtccttcctcagcgagtcgtgtgatttttcaccaatggccgctcgcgtttctttagcgaggtctaagcgatggaaggtggcggccagggagacgccccctacgcgtcctgggattggctacgtcgcacggcgcgcgagggcggcgggcccgaaagataagaactacgactcccggcgccccgcaaagggaactccgttacgcatgcgcacgggcggggcgaaaaagcttctatataaaaggggcgcagaggactgggagacagcagttggaagttggcaggtggagaggcaggttgggagggaaagtcgggggaggacgcggaagaggagctgtgggaagggggaggagggagggaggaaaagaggaggaggcggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagaaaaagttcgacgagaaacagagccttcgagcttcaaggatccgagccgagatgttcgccaagggccagccggtcgcgccctataacaccacgcagttcctcatggatgatcacgaccaggaggagccggatctcaaaaccggcctgtactccaagcgggccgccgccaaatccgacgacaccagcgatgacgacttcatggaagaagggggtgaggaggatgggggcagcgatgggatgggaggggacggcagcgagtttctgcagcgggacttctcggagacgtacgagcggtaccacacggagagcctgcagaacatgagcaagcaggagctcatcaaggagtacctggaactggagaagtgcctctcgcgcatggaggacgagaacaaccggctgcggctggagagcaagcggctgggtggcgacgacgcgcgtgtgcgggagctggagctggagctggaccggctgcgcgccgagaacctccagctgctgaccgagaacgaactgcaccggcagcaggagcgagcgccgctttccaagtttggagactagactgaaacttttttgggggagggggcaaaggggactttttacagtgatggaatgtaacattatatacatgtgtatataagacagtggacctttttatgacacataatcagaagagaaatccccctggctttggtttcgtaaatttagctatatgtagcttgcgtgctttctcctgttcttttaattatgtgaaactgaagagttgcttttcttgttttcctttttagaagtttttttccttaatgtgaaagtaatttgaccaagttataatgcatttttgtttttaacaaatcccctccttaaacggagctataaggtggccaaatctgagaacaattaaattcattttagttataataaatttaatatttgtaaatgtaacatagtttcagtgtgatttctagagctaattcaaaatagtattgatatattttatgtgactgcatttttggggaggggtaccgaaatcgttaaatttgtcagtttgcaaaaatatcaatctttaatgggagaattttcaatttgccaattttttccttgaatgggtttaagtatgctacaatatacagttcaggcaaaatttaagatgtaattatcttcaatacttaagtgtgcttgctttctagtgccttggttttctttcttgatgctggaaaaataaacaaaccggtattgagtgtttaggcgagtggaaagtggctacaatccaaaattttaaatttaactctgcctcggccattcaaaagtctaataacaaaaaatgtaaacctaatttggcagtttgttaggttagacaactgacagcctcatttcattcctacaagttggttttcagtaatctcttccttccccccagtaaggctggaagaggctcttggcaaacttcttagtgcaagcaatggttagattaatttgtgaggcagctctttaagacgttcagaggtaagaaatactggatttataaagcaaatggctgtttgggggattccaaggatttacctaattgtccaattctacgtgctctctataccaaaacaaaaaaaaaaagctatccacctttccatgtgggtcaaactaaaattagaaatgtcccctcactgcagatcaaatgtaaagcttccagttaaggagctaaatgaggtcctcagctgaatgaggaaccctgtacatccccttgcacagccctattctaaatcgcttaaactatgctgatagctgcttaggttcttgagtagttctgctcttaaacgtagggaggccctgagaactaaattttgccccaaaataaaaacagaaattatgagattgcctcctgtcattttggttaacccagtccttcacctgccctgtgtcagtgtcttctgagggcaattgcgttgctcaaatcactagcacagaggttccttaatttggggccttagaaaccattgtgggccttggggtccatgaaccccatgaaattatttgtagacttgtatgtacatttttctggggagaaggttcaagagattcataagattgtcaaactccttgaaggttcagaacctctgcagggaagggggaagaaaaccctcccattaggaagcatgcttttgcagttaaatggcgatggtggaggtgatagggacttcaagagtaaaatgcaccttgtattgcataagaagcatacacaaatcaataaatcaagggagattataccagtaggactgaatcagggccttcaaagctggactgagttggtcctgttctggcacatatggtccactggagacaatgtatgattgagtttttctttggtctaaaaattatattaaacatttattttgaaata

SEQ ID NO: 1047 - DNA, 6414 bp, Homo sapiens
gagttgtaggcctccggcgtcagcccgcgggctgccgcccgcactctccaagagactgctggcgccggcgcccgcccgcgcggcaccgacgcggggagcgcgcttcgcgctgactcagcggcggcggcggctgcggcggcggcggcggcgttagccggccctcgcgctctttcccttcctggggcgccgaccccgcccgcttgcttgcttgcttgcttgcctgcctgcctgcctgcccggcgccacgcaagagaaggtgccaggggacgcagagcgactagaggcgcgcggtcccggccagcaccgtctctggcgttgtagctgcggccgtggcggaggactacggcgacaaggacgagggccgctctcccagctctctgcgtgccgcgccgctccgctccgctggctgaccatctggagtgcaggctgggaggcgggatggagtgatagggaagatgtttataaattcttctgtgggatcagagggcacgcctattacaaccagaaaactacaagtataacagcgaggatggatgaacaggctctattagggctaaatccaaatgctgattcagactttagacaaagggccctggcctattttgagcagttaaaaatttccccagatgcctggcaggtgtgtgcagaagctctagcccagaggacatacagtgatgatcatgtgaagtttttctgctttcaagtactggaacatcaagttaaatacaaatactcagaactaaccactgttcaacaacagctaattagggagacgctcatatcatggctgcaagctcagatgctgaatccccaaccagagaagacctttatacgaaataaagccgcccaagtcttcgccttgctttttgttacagagtatctcactaagtggcccaagtttttttttgacattctctcagtagtggacctaaatccaaggggagtagatctctacctgcgaatcctcatggctattgattcagagttggtggatcgtgatgtggtgcatacatcagaggaggctcgtaggaatactctcataaaagataccatgagggaacagtgcattccaaatctggtggaatcatggtaccaaatattacaaaattatcagtttactaattctgaagtgacgtgtcagtgccttgaagtagttggggcttatgtctcttggatagacttatcccttatagccaatgataggtttataaatatgctgctaggtcatatgtcaatagaagttctacgggaagaagcatgtgactgtttatttgaagttgtaaataaaggaatggaccctgttgataaaatgaaactagtggaatctttgtgtcaagtattacagtctgctgggtttttcagcattgaccaggaagaagatgttgacttcctggccagattttctaagttggtaaatggaatgggacagtcattgatagttagttggagtaaattaattaagaatggggatattaagaatgctcaagaggcactacaagctattgaaacaaaagtggcactgatgttgcagctactaattcatgaggatgatgatatttcttctaatattattggattttgttacgattatcttcatattttgaaacagcttacagtgctctcggatcagcaaaaagctaatgtagaggcaatcatgttggccgttatgaaaaaattgacttacgatgaagaatataactttgaaaatgagggtgaagatgaagccatgtttgtagaatatagaaaacaactgaagttactgttggacaggcttgctcaagtttcaccagagttactactggcctctgttcgcagagtttttagttctacactgcagaattggcagactacacggtttatggaagttgaagtagcaataagattgctgtatatgttggcagaagctcttccagtatctcatggtgctcacttctcaggtgatgtttcaaaagctagtgctttgcaggatatgatgcgaactctggtaacatcaggagtcagttcctatcagcatacatctgtgacattggagttcttcgaaactgttgttagatatgaaaagtttttcacagttgaacctcagcacattccatgtgtactaatggctttcttagatcacagaggtctgcggcattccagtgcaaaagttcggagcaggacggcttacctgttttctagatttgtcaaatctctcaataagcaaatgaatcctttcattgaggatattttgaatagaatacaagatttattagagctttctccacctgagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaaaagttgatgctggcacaagatgaagaaaggcaagcctctctagcagactgtcttaaccatgctgttggatttgcaagtcgaaccagtaaagctttcagcaacaaacagactgtgaaacaatgtggctgttccgaagtttatctggactgtttacagacattcttgccagccctcagttgtcccttacaaaaggatattctcagaagtggagtccgtactttccttcatcgaatgattatttgcctggaggaagaagttcttccgttcattccatctgcttcagaacatatgctcaaagattgtgaagcaaaagatctccaggagttcattcctcttatcaaccagattacggccaaattcaagatacaggtatccccgtttttacaacagatgttcatgcccctgcttcatgcaatttttgaagtgctgctccggccagcagaagaaaatgaccagtctgctgctttagagaagcagatgttgcggaggagttactttgctttcctgcaaacagtcacaggcagtgggatgagcgaagttatagcaaatcaaggtgcagagaatgtagaaagagtgttggttactgttatccaaggagcagttgaatatccagatccaattgcacagaaaacatgttttatcatcctctcaaagttggtagaactctggggaggtaaagatggaccagtgggatttgctgattttgtttataagcacattgtccccgcatgtttcctagcacctttaaaacaaacctttgacctggcagatgcacaaacagtattggctttatctgagtgtgcagtgacactgaaaacaattcatctcaaacggggcccagaatgtgttcagtatcttcaacaagaatacctgccctccttgcaagtagctccagaaataattcaggagttttgtcaagcgcttcagcagcctgatgctaaagtttttaaaaattacttaaaggtgttcttccagagagcaaagccctgaggactggatttccctgtgcctacttcatgatcatgaattccagttaatttataaagaggcgatttttgtgtgccattcacactggtctttttcacattgttttgagcttattgcagtatatgttttgggatttttctgtaaaatgggtgtaattttcctaatacaggtatgtaacaacaaaagaagttgcctgcatgccggtccaaattgttctgtataaagatgctcttaaaagacacaagagttatcctagaaccttaattcttttttatttgaaattttaagtcaagtcctttataaagaccatagcagtggaaaacagtgtactttttaaaaaattgctgaatataaaatctttgaaaattttctttatgtgtgaagacacaaagtatgggggaagacagcaatcaaaactaactttttgtagatagccatttcatttctttaaactgtttcaacgccaatatgtattctacaaaagagaatggttttaggctccagtgttatacttttttttatatatatatataaaaataaactttacgtagtgaaatcttccaagtcttttctggaattattataaatactttagttttattttctcatcttaatctctccataatttcccatttaaaggtttacaaatatgagtgtgtggatgctttaattcatttaacctcactcctcaaaggtaacatgcaacttagttctgttatatgagagtctttttctttaatgtactggaaaaagcctatgtgaatctgttgatagaatttaaaattccaggccgggcgtggtggctcacgactgtaatcccagaactttgggaggccaaggcaggtggatcacttgaggtcaggagttcgagactagcctggccaacatggtgaaaccccatctctactaaaaatacaacagccaggtgtgatggtgcacgctcgtaatcccggctactcaggaggctgaggcaggagaatcgcttgaacccggaaggcagaggttgcagtgagctgagattgtgccactgcacgccagcctgggcaagagagtaagactctctctcaaaaaaaaaaaaaaagaatttaaaatcccaatttattttctaactcttttattggatgtatttagaacacagtatacctatagtatacctatgtgtttattatgtttgtaaatggtaactgacatttaattattagaagtacttacccctgccttcctccatttttattcatggctacttgagaaagcaaaaggaaaaaataatagttatcagtagtgtcactggaaagaagagaggagggacaaaactgagcagcagaattcgtatagacatttacgtttaaattctaaaagcccaattgagatgttcagggagggtttgttttgccctttggcctcatgaatgggtttcatgaatgggcttcagtggcttataaactctgtaaaattctattctaaattttgtacatttattttgttccggttaattccagaagacatttcaaacatttttcttacaccatataataaaaatacttaactaaattgacagttataaaaataaatcagtgaaatgtaccttatactttaataaaaaatgttttcagaaatagataagtgaaagctgagtgtttctttgataggttcccctgtactataggagtgataattgcagctattgcaatagtagtaattgttaaatggatactaatgaatagcatagcatagtgggtaagagtttatatagcacaggctctagaatcagattaagtaggttcaaataccagttctgccagtaactggttttagaaccttgggcaagttaaagaatgtctcccagcctcagtttccctatttgtaaaatggaaataatggtagctacctcaaacctcattacgaattcaatgagttaaacttgaaaagacttattacagtagctggcacataaagacttgatagtagtttatatggatgctatctcatattagcatatatggaattaatagtgtatcactatactttttttttcttttttttttttgaatagagatcagtctatcacccaggctggagtgcagtggtgacatcatagctcactgtaacttctcccatactctaccaatcctcctgcctcagcatccagactagctgtgattacaggtgtgcaccaccacacccagctacatttttttttggtagagacagggtctcactatgttacccagtctggtctcaaactcccggcctcaagcaatcctcccactggcctcacaatgttgggattacaggtataagccactgcacacggccttactatgctatcaattccatatatggaaaggtgttttccctttcagagctctttaaagctctgcagaagatttacatgtgtttatagagctaagagaaatcagggcatggaaattgagtgtgtaataaaaattaaactcttcatgttatataatcatgcataacttctatcttcattctctgaagttgcctagagcaccatcacagctaggaagcttccatcatgaattaccttatttccaaaagcaagtactcaaataattgtctcaagagaggaaggacaaaactgttacaagctgaaatatttggggatttgtttgacttgactagggaaccacaagttttcatataatgcctgatttagccctgtgcctaacagtttaaatcttaatgctaatgttaattgcttcccagttggttgaccttataagaaaacactgtgtggtattttaatgtggtaaacatgtgaatgaaggcctgtggctcagttaatcactcccacaactttgagctgtgagttttactggtggaaggaactttaacaggtcttcgctcttgtcattagatatcaaagaactgaaattagttggaattgtaagcagtgaatagatgtgttgttagaatgattccatcacttatacattgtttaaaatgctaataaagtaacttgctttgtaagaatt

SEQ ID NO: 1048 - DNA, 3484 bp, Homo sapiens
acacctcagttcacaatcctggggcgatatggcagaatcttttttttcggattttggcttgttgtggtatctgaaggagctcagaaaggaagagttttggaaatttaaggagctcctcaaacaacctttggagaaatttgaactcaagccaatcccctgggctgagctgaagaaggcctccaaagaagatgtagcaaagctgctggacaaacattacccaggaaagcaggcatgggaggtaacactgaacctgtttctacagatcaataggaaagatctctggacaaaggctcaggaagagatgagaaataagctaaacccatacagaaagcatatgaaggaaacatttcaactcatatgggagaaggaaacctgtcttcacgtccctgagcatttctacaaagaaaccatgaaaaatgagtataaagaattgaatgacgcatatactgctgcggctagacgacacactgtggtcctggaaggtcctgatggaattggaaaaacaacccttttaagaaaagtgatgttggactgggcagagggaaacttatggaaggacaggttcacatttgtgtttttcctcaatgtctgtgaaatgaacggtatcgcagagaccagcttactggagctcctctctagggactggccggagtcttcagagaagatcgaagacattttttcccagccagagagaattctgttcatcatggatggctttgagcaactgaagtttaacttacaacttaaggctgacttgagcgatgattggaggcagcggcagccaatgccaattatcctgagcagtttgttgcaaaaaaagatgcttccagaatcctctctccttattgcattaggaaaactggctatgcaaaaacactattttatgttgcggcatccaaaactcataaagctcttaggattcagtgaatctgaaaagaagtcgtatttctcctacttctttggtgagaagagcaaagccctgaaagtcttcaattttgtgagagataatgggccgctgtttatcttgtgccataatccctttacgtgctggttggtctgtacttgtgtgaaacagaggctagagaggggagaagaccttgaaataaactcccaaaacaccacctatttatatgcatcctttttaacaactgtattcaaagcaggaagtcagagttttccacctaaggtgaacagagcccgactaaaaagcctgtgtgctttggctgcagagggaatttggacatatacatttgtattttcccatggggatctccggaggaatgggttatctgagtctgagggcgtgatgtgggtgggtatgagactcctccaaaggagaggggactgttttgccttcatgcatctgtgtatccaagagttttgtgccgccatgttttatttgctcaaacgacccaaagacgatcctaacccggccattggaagcataacccagcttgtaagagcaagtgtggttcagcctcaaaccctcttgacccaggtggggatattcatgtttggaatttcaacagaagaaatcgtcagcatgctggagacctcctttggttttccactgtcaaaagacctaaagcaggaaataacccaatgccttgaaagtttaagtcaatgtgaagctgatagggaagccatagctttccaggaactattcattggtttgtttgaaactcaggaaaaagaatttgtaaccaaagtgatgaatttctttgaagaagttttcatttatattggtaacatagaacatttggtaatagcttcattctgcctgaagcattgtcaacatttaacgacacttcgcatgtgtgtggagaatatctttccagatgactcaggatgcatctcagattacaatgagaagctcgtctactggcgggagctttgctcaatgttcattaccaacaagaacttccagattttagacatggaaaataccagccttgatgatccctccctggcgattctttgcaaagcgctggctcagcctgtttgtaaactccgaaaactcatatttacttctgtgtactttggacatgattcagaattatttaaggcagttcttcacaaccctcatctgaaacttctgagcctgtacggcactagcctctcccagtctgacatcagacacctgtgtgagacgctgaaacatccaatgtgcaagatagaagagctgatactgggaaagtgtgacatctccagtgaagtttgtgaagacatcgcctccgtcctggcctgcaacagcaagctgaaacacctctccttggtagaaaatcccttgagggacgaaggaatgacgttgctgtgtgaagccctgaagcactcacactgtgccctggagaggctgatgttgatgtactgctgtctcacctctgtctcctgtgactccatttccgaagtcctcttgtgcagtaagtccctgtccctcctcgatctgggctcaaatgccctggaagataatggagtggcatctctgtgtgcagcgctgaagcacccaggctgcagcatacgggagctgtggttgatgggctgtttccttacttccgattcctgtaaggacattgctgctgttcttatttgcaatgggaaactgaagaccctgaaacttgggcataatgaaataggagacactggtgtcagacagttatgtgcagctttgcagcatcctcactgtaaattagagtgtctcgggctgcaaacgtgtccgatcacccgtgcctgctgcgacgacatcgccgcagcactcatcgcctgcaaaacactgaggagcctgaacctcgactggattgccttggatgctgatgcagtggtggtgctgtgtgaggcattgagccacccggactgtgccctgcagatgctggggctgcacaaatctggctttgatgaagaaactcagaagatcctgatgtctgtggaagaaaaaattccccatctgaccatttcacatggaccttggattgacgaggaatacaagatcaggggtgtgctcctctgatggggaacaccctgaagtagtcgtctcacaaaggctttccttggccacagtgggaccttcacctggcacctctatcctgtaattgcacatcatggcagcagggctgtgatttcagaggtactccctaagtgttctagcaatatgattatggagtgtgattcagtgtacatgctgattgtctttgcctcggtcctatatccccttgtctttagaaatcccatcctgccttgtgatatttagaagcacaagtacgttaaacaagtgctaaacgctctggaaagcatggctttattttcttaatggatgtcttggtgtgtaggagcatgcatttgtaggcaccacaatccggatacttctgacacagaagtgatgctagaatgtgtctatagattgtattgctagcatccagactttctagtttgtccagatttcgatttgatcaattttcttgtccaataaaaaagcatttccaaatctcta

SEQ ID NO: 1049 - DNA, 868 bp, Homo sapiens
gagattcctaaatcattgcaggttaattgtgagaggggaccagtcccagaggctctcagctctgcagtgcttccgaatcactggacgactctttaagaattctgatccccgggcccccatcccggaccaatgaaatcagaatctctaatagtggggccctggcatcggtagtttttaaagctgcccaggtgattctggggtgccgagaaccaccgtgttaagctccaccagcccattggagaaaagttactgttcagtccctgaaggcttgtgccataaaagagtgggagacattcccagggagtttcagcacccatttggactttcacaatcagagatggcagcggtaaaggcatcaacatcgaaagctaccaggccttggtattctcatccggtatatgcaagatactggcaacattatcatcaagcaatggcttggatgcaaagccatcacaatgcctacaggaaggccgtggaatcctgtttcaatcttccatggtacttaccttctgcgcttcttccccaaagctcttacgataatgaggctgcgtatcctcagtccttctatgaccatcatgtggcctggcaggactacccctgcagttcttcacatttcagaagatctgggcagcatccacgttacagcagtaggatccaggcatccacaaaagaagaccaagctttgtccaaagaggaagagatggagactgagtcagatgcagaggtagaatgtgacctgagcaatatggaaatcactgaagagctccgccagtactttgcagagaccgagaggcatagagaagaacgacggcggcagcagcagctggatgcagagcgcctggacagctatgtgaacgctgaccacgac

SEQ ID NO: 1050 - DNA, 1969 bp, Homo sapiens
ggcgtcgtggggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcatggtggggaggagctgtggggtggcaacccagaggcaaggaggtgggcagaggcccacgaacctggccctgaccctcagctcgtccccagctcacagcacagccctcccctggctgcctccaaggagtctccagttactgagtggccactccgtgccagctcagcccacccctcaccttcccagtgcctgtggaggcccaactagggtgacgctgggagaggagagggcttggaggagccacgggtcaaatgcaggaggccacacctgcctgcccaggaggactgcaggagccggatccttaacacctggaggggagcgggggggcaacaacgccggccacacggtggtggtggatgggaaagagtacgacttccacctgctgcccagcggcatcatcaacaccaaggccgtgtccttcattggcaacggggtggtcatccacttgccaggcttgtttgaggaagcagagaagaatgaaaagaaaggcctgaaggactgggagaagaggctcatcatctctgacagagcccaccttgtgtttgattttcaccaggctgtcgacggacttcaggaagtgcagcgccaggcacaagaggggaagaatataggcaccaccaagaagggaatcggaccaacctactcttccaaagctgcccggacaggcctccgcatctgcgacctcctgtcagattttgatgagttttcctccagattcaagaacctggcccaccagcaccagtcgatgttccccaccctggaaatagacattgaaggccaactcaaaaggctcaagggctttgctgagcggatcagacccatggtccgagatggtgtttactttatgtatgaggcactccacggcccccccaagaagatcctggtggagggtgccaacgccgccctcctcgacattgacttcgggacctacccctttgtgacttcatccaactgcaccgtgggcggtgtgtgcacgggcctgggcatccccccgcagaacataggtgacgtgtatggcgtggtgaaagcctataccacacgtgtgggcatcggggccttccccaccgagcagatcaacgagattggaggcctgctgcagacccgcggccacgagtggggagtgaccacaggcaggaagaggcgctgcggctggctcgacctgatgattctaagatatgctcacatggtcaacggattcactgcgctggccctgacgaagctggacatcctggacgtactgggtgaggttaaagtcggtgtctcatacaagctgaacgggaaaaggattccctatttcccagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcagtcaaatgggttggtgttggcaagtcaagagagtcgatgatccagctgttttagtcacagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaa

SEQ ID NO: 1051 - DNA, 468 bp, Homo sapiens
atggtcaactcctgttgtggctccgtgtgctctgaccaaggctgtggccaagacctctgccaggagacctgctgctgccccagctgctgtcagaccacctgctgcaggaccacctgctaccgccccagctacagtgtgtcctgctgctgcagaccccagtgctgccagtctgtgtgctgccagcccacctgctgtcgccccagctgctgtgtgcccacctgctgccaccctagctgctgcatctccagctgctgccgccccagctgctgtgtgtccagctgctgcaagccccagtgctgccagtctgtgtgctgccagcccaactgctgccgccccagctgctgccgcccctgctgctgcctgcgtccagtctgtggccgagtctcctgccacaccacttgctatcgcccagcctgtgtcatctccacctgcccccgccccgtgtgctgcgcctcctcttgctgctga

SEQ ID NO: 1052 - DNA, 3008 bp, Homo sapiens
ccctcgccgcagtcgcgggcaccccgctcggcgtcggtgcctgagggaggccgcgatggcggccgaggccctggcggcggaggccgtggcgtcgcgcctggagcggcaggaggaggacatccgctggctgtggtcggaggtcgagcgcctgagggacgagcagctgaacgcgccctacagctgccaggcggaggggccgtgcctcacgcgggaggtggcgcagctccgggccgagaactgcgacctgcgccaccgcctgtgcagcctgcggctgtgcctcgccgaggagcggagccgccaggccacgctggagagcgcggagctagaggcggcgcaggaggccggcgcacagcctcctcctagtcaaagccaagacaaggacatgaaaaagaagaaaatgaaggaaagcgaggctgacagcgaggtgaagcatcaaccaattttcataaaagaaagattgaagctttttgaaatactgaagaaagaccatcagctcttacttgccatttatggaaaaaagggggatacaagcaacatcatcacagtaagagtggctgatgggcaaacagtgcaaggggaagtctggaaaacaacgccttaccaagtggctgctgaaattagtcaggaactggctgaaagcacggtaatagccaaagtcaatggtgaactgtgggacctggaccgcccattggaaggggactcttctctagagctgcttacatttgataatgagaaagttaacactgcaactaccaccgtgtacaggtgcggtccattaattgacctttgcaaaggtccacatgtaagacacactggaaaaattaaaaccatcaaaatttttaagaattcctcaacatattgggagggcaatccggaaatggaaacattgcagaggatctatggaatatcctttcctgataacaagatgatgagagactgggaaaagttccaagaggaagcaaagaaccgagatcacaggaagatcgggaaggaacaagaacttttctttttccacgatttgagtcctggaagctgttttttccttcccagaggagccttcatttataatacgcttacagatttcatacgagaggaatatcacaaacgggacttcacggaggtgctctctcccaatatgtacaacagtaaactctgggaagcctcaggccactggcagcattacagcgagaacatgtttacctttgagattgaaaaggacacttttgccctcaaacccatgaattgtccagggcactgtctaatgtttgcccatcgtccacgatcttggagggaaatgcctattagatttgctgattttggagttctgcatagaaatgaactgtcggggactctcagcggcttgaccagagtgaggcgcttccagcaggacgatgctcacattttttgcacagtggagcagattgaagaagaaataaaggggtgtttgcagtttttgcaatctgtttactcaacatttggcttctcctttcaattaaacctgtcaacaaggccggaaaacttcctaggagagattgagatgtggaatgaggctgagaagcaactgcagaacagcttgatggactttggagaaccgtggaaaatgaacccaggagatggagcattttatggccctaaaattgacataaaaatcaaggatgctattggcagataccatcaatgtgctacaattcagctggacttccaactgcctattagatttaatctcacatatgttagtaaggatggggatgataagaagagacctgtgatcattcatcgagccattttgggatcagtggaaagaatgatagccattctttcagaaaactatggcggaaaatggcctttctggctatctcctcgtcaggtgatggtcatccctgtggggccaacttgtgaaaaatatgcacttcaggtatccagtgaattttttgaagaaggatttatggctgacgttgacttggatcacagttgtacactaaataagaaaatacgaaatgcacagctggctcagtataattttattttggtggttggagaaaaggaaaagatagataatgctgtaaacgtgcgaacaagagacaacaaaattcatggagagattttagtaacttctgccattgataaactgaagaatctcaggaagacacggacactcaatgctgaggaggccttttgaagtccttccctgatatttgcttctgtgtaactttgttttgacccttaaaaatgtatttttcttaacatgttagtacttctacgactttggagccactgatgggtccactcatggcctcagctgagaaaggagacgatgaacgtgtagctgacatgcacgaagtttaatttactcatgtccacgggggacgtttagagggcacgtgggaaattttccagcaatcaatgccttgagaaacttaaatggggaaatattattcatcgagaaagtgaaacaaaacactaggaaatgattatgaaatgttagtgattttcaaaagatgggcttcaaataaaagtctgcagagttttttttaaataggagggaaaatcttattttctaatatgtctcaggtatttttatgacttctactaaaattcacactgaaactttatcttctaaactggaatcattacttaattttaactaaccaacaaccacaaaagcagcagctactgctaaatattggattactgacaaaggaattcagttttgtggaatctggtgtttgcactataggttaagagttgccatttaaatgtttcttattcataattaggttttgttccgctttagaaaaaaataaattcccaaatgaattgcatcagtgtttccagcgtttcagctgtgggcttctaccaccactaagccgctcacctagagttgttacttttttgatgggatgacattccatggatttatgtactgaaatggatttcagattttaaagagaggaatgctctacgtgctcagaactgaattaaaatggcattatgtcaatagagaattc

SEQ ID NO: 1053 - DNA, 3686 bp, Homo sapiens
agccaagttctttccatcatcctgggccctcacctctggcataggctcttggtagtgggggcccagacagggaggcacctgccacctgcttcccttctcagccacccacagccctcatagggcagaatgggactcttgctgatgtagacgccgaagtcgcgggcgctcatggcgggcctggaggtactgttcgcatcggcagcgccggccatcacctgcaggcaggacgcgctcgtctgcttcttgcattgggaagtggtgacacacggttacttcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagatggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtgacctgttcctccttttttaaatagcagctttattgagatataatttacatacccataatttacatacctgtttaaagtatacaattcagtggatttagtatgttcacagtgttgcacatccaccaccatttctaattcctgaacattttcaccacctcaaaaagaaaccacacacccattggcatgactccccattcccttgctcccagccccaggcaaccactaacatctgtctctaaagattttttttttttttctggacagttctcataagtggaatcactcagtattatggccttttgtgtctggcttctttcatttcatgtgatgttttcaagattcattcatgctgtagcatgtatccatggtatggatatatcacattttgcttatccttttatcagttgatggacagttgggttgtttctacaaaaaggctattatgagtaatgcagccaagaa

SEQ ID NO: 1054 - DNA, 574 bp, Homo sapiens
cggaagccgcggttcctaccaaccgttcttattgctggcggcctgaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgccttt

SEQ ID NO: 1055 - DNA, 747 bp, Homo sapiens
atcctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacg

SEQ ID NO: 1056 - DNA, 1387 bp, Homo sapiens
agttgcaacccgggccgcccgcagaggcaggcggggcccaggtggcgtggaccgcccgtcaccagctctgcctcgccagtctgagtccgacttattaactagcttccgtcattcatcaacacgcgctattgggcatcttgcgagcgccgggctccgcgccggcgccggaatgcgatccgggcttcggactcgaacgaatgcgggggacgagccaaccctggtgggggaggctggggcggacgcgtttattagaagatcggggccgtttgcctagacatgaacatttggactcggaggagcagagggacgccccctcggccgctccggctgcactgcggagccgaggcccgcgcgagggcgcagaccgaccaaccggctagggcctgactggctagactgtgcccgctgcagaggcgcgctcccagcacagggcggggacggaagggaggaccccgagccgcgtgaaacgcaaggccctcgtgtgtgcgcagctgacaccctaggcggggctgcgtcgggggcggggacaggcgcgtcccagcccacgcagccggaacgcctgagcgctgggcgcctggtctgccggacctcagcagggggcaccgcgggccggactgtggaggggcgcacgcccggaagcggcgagggtagccatgacggcctccgtgctgcgaagtatctcgctagccctgcgcccgactagcgggcttctgggaacttggcagacgcagcttagagagactcaccagcgagcgtcattgttgtctttctgggaactcattcccatgagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggatcctaacctgttcccctttgagaaggaagggccacattacacaccaccgatccctaactaccaaccccctgaaggcaggtacaatgacatcaccaaggtgtacacacaagtggagtttaagagatagacttgcaggctgctatccttaacatgctgcccctgagagtaggaatgaccagggttcaagtctgctttccacagaatcaggcatgctgttaataaatactggtttaatcaaaa

SEQ ID NO: 1057 - DNA, 10141 bp, Homo sapiens
aggtctttgcctccgcgtcactttctcctcatcgagtccccggaggcagagagctgagcgaggttcgcctccccgggcgggacacgagctccggtcctctcttggcgcaaacccccgccccccgcggagggactacttttcgtctcccgcggaggaactacttcctcccccgcggaggcgtcggtccaggcggcgcgcacggtatggcggcggcggcggcggcggcggcgcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaagactgcaggcacacagtttggaagggctctgcctttgctgctcttcatagaggaagacctcctgaaatgccagtgaattatggttccccaccaaatcttgtggagatacatcgaggaaaacaactcacagggtgttccacttttagtacagcatttccaggaactatgtatcagcatataaaaatgcacagaaggattctcggacatctatctgctgtttactgtgtagcatttgataggacaggacatagaatctttacaggttcagatgactgtttggtaaagatttggtcaacacataatggccgcttgttatctacattaagaggtcattctgcagaaatttcagatatggcagtaaactatgagaatacaatgattgctgcggggagctgtgataaaattattagagtgtggtgcttgagaacttgtgccccagttgctgtgctccaaggacacacaggatcaattacatctttacagtttagcccgatggccaaaggctctcaaagatacatggtttccactggtgctgatgggacagtttgcttttggcaatgggatttagaatccttaaaatttagcccacgtcccctgaagttcactgaaaagcctaggccaggcgttcaaatgctttgttcttcttttagtgttggtggtatgtttttagccacaggtagtactgatcatgtaatcagaatgtattttttgggttttgaagcacccgaaaaaatcgcagaacttgaaagccacactgataaagtagatagtatccaattttgtaacaatggtgatcggttcctaagtggtagcagagatggaacagcacggatttggagatttgagcagttagaatggaggagcattttattggatatggctaccagaatctcaggggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatgggacatgctgatgaagtatttgttctggagacacatccctttgattccagaattatgttatctgcaggacatgatggcagcatatttatatgggatattacaaaaggtaccaagatgaaacattattttaatatgattgaaggacaaggacatggagctgtgtttgactgtaagttttcacaggatggacagcattttgcctgtacagattctcatgggcaccttctgatatttggttttggatgcagcaaaccatatgaaaagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaccactaggcatatttaggaagctggaagacttccgattagagaaaggtgaagaggaaagaaatctttatataataggaagaaaaagaaagactcttcagctctcacataagtcggattcagtggttttggtatcacagtctagacaaaggacatgtaggcgtaaatatccaaattatggtagaagaaatcgtagctggcgtgagttatcttctggaaatgagtcttcaagctctgtaagacatgagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaagaacatcatgtcgtcgacgaattactcgattttgtagtagttcagaagatgaaatatctactgagaatttatctcctccaaaaagaagacgaaagagaaagaaagaaaataagcctaagaaggagaatttgcggaggatgactccagcagagcttgcaaatatggagcatttatatgaatttcaccctccagtttggattactgacaccacacttagaaaatctccttttgttcctcaaatgggtgatgaggtaatatattttcgacagggtcatgaagcttatattgaggctgtaagaagaaataatatttatgaactgaaccctaataaggagccatggagaaaaatggatcttagggatcaagaattggttaaaatagttggaatacgatatgaagttgggccccctacactctgttgcctaaaactagcatttatagatccagcaactggaaaacttatggacaaatctttctctattagatatcatgatatgccagatgttattgactttcttgtattgcgtcaattttatgatgaagcaagacagaggaattggcagtcttgtgacagattccgctctattattgatgatgcttggtggtttggaacagtgttaagtcaagagccatatcaaccacagtatcctgatagtcatttccagtgttatattgttaggtgggataatactgaaattgaaaaacttagcccatgggacatggaaccaattcctgataatgttgatccacctgaagaattaggagctagtatttctgtcacaacagatgagctagagaaattgctctataaaccacaagctggtgaatggggtcagaaatcaagagatgaagaatgtgatagaattatcagtggtatagatcaacttttgaatcttgatatagcagcagcttttgcaggccctgttgatttgtgtacatacccgaagtactgtactgtagtagcttatccaaccgatctttacacaattcgaatgagacttgttaatcgattttacaggaggctgtctgcgttagtttgggaagtcagatatatagaacataatgccagaacatttaacgaacctgagagtgtaattgcaagatcagctaaaaagataactgaccaacttttaaaatttatcaagaatcaacactgtacaaatatctcagaactttctaacacatctgaaaatgatgagcaaaatgctgaggatttggatgatagtgatcttcctaaaacatcttctggaaggaggagagtccatgatgggaaaaaaagcatcagagctacgaactatgttgaaagcaactggaagaaacagtgtaaggaactagtgaacttaatttttcagtgtgaagattctgaaccatttagacaacctgttgatttggttgaatatccagactacagagatattatagataccccaatggattttggaacagtaagggaaactctagatgcgggaaattatgacagccctttggagttttgcaaagacatccggctgatatttagcaatgcaaaagcgtatacaccaaacaaaagatcaaagatttatagtatgaccttgagattatctgccttatttgaagaaaaaatgaagaaaatctcttctgattttaaaattggtcaaaaattcaatgaaaaacttcgaagaagccagaggttcaagcaacggcaaaattgtaaaggtgacagtcagcctaacaaaagtatcagaaacctcaagccgaagaggttaaaatctcagacaaaaataattcctgagttggtaggttctcctacccagtctacctcaagtaggacagcttatcttggaacccacaagacaagtgctggtatctcttcaggtgttacttctggtgactcttcagattcagcagaatcatcagaaaggaggaaaagaaatagacctataacaaatggttctacattatctgaaagtgaagtggaagattctttagctacctctttgtcatcgtcagcttccagtagttctgaggaaagcaaagagagttccagagctcgtgaatcctcctcacgcagtgggctatccagaagcagcaatctcagggtaaccagaactagagctgctcaaagaaaaactggtcccgtttcattagcaaatggatgtggcagaaaagccactcgaaagagagtctatttaagtgattctgataacaattcattggagactggtgaaattctaaaagccagagctggaaataaccgaaaagtcttaaggaagtgtgctgctgtggctgccaataaaataaagctaatgagtgatgtagaagagaattctagctctgaaagtgtctgttctggtcggaagctgcctcaccgcaatgcttctgctgtagctagaaaaaagttattacataattctgaagatgaacagagcttaaagtcagaaattgaagaagaggagctaaaagatgaaaatcaactattaccagtgtccagttctcacactgcccagagcaatgttgatgaatctgaaaacagagactcagagtcagaaagtgatttgcgggtagcccggaaaaattggcatgctaatggttacaagtcccatactccagcaccttcaaagacaaaatttcttaaaatagagtcttctgaggaagactctaaaagtcatgattcagatcatgcatgtaacagaactgctggcccatcaacgtctgtgcagaaacttaaggcagagagcatctcagaggaagcagattctgaaccaggaagatctggtggtaggaaatacaatacatttcacaagaatgcgagtttctttaaaaaaaccaagattctgagtgactcagaagactctgaatctgaagagcaagatagagaagatgggaaatgtcataaaatggaaatgaacccaatttcaggaaatctgaactgtgaccctattgctatgtcccagtgttcctcagatcatggatgtgaaactgatttagattcagatgatgacaaaatagaaaaaccaaacaattttatgaaagattctgcatcacaagacaatggactaagcagaaaaatttccaggaaaagggtctgttccagtgactcagacagtagtttacaggtggttaagaaatcatcaaaagccagaacaggtctcctgaggattactcgaagatgtgcagctacggctgccaataagatcaagctcatgagtgatgtagaagatgtcagtttagaaaatgtgcacactagaagcaaaaatggaaggaaaaaacctctccatcttgcttgtactacagctaagaagaaattgagtgattgtgaaggaagtgtacattgtgaagtaccaagtgaacagtatgcctgtgaaggcaagccacctgatcctgactccgaaggtagtacaaaagtgcttagtcaggctctaaatggagactcagactctgaagatatgttgaattcagaacacaagcacaggcataccaatattcacaaaatagatgcaccttctaaaagaaaaagttcctctgttacatcttcaggagaagattcaaaaagtcatattccagggagtgagactgataggacattttcttcagagtcaaccttggcacaaaaagctactgcagagaataattttgaagtggaactgaattatgggctgcgcaggtggaatggcagaagactcaggacctatggaaaggctccttttagtaagacaaaagtgattcatgattcacaggaaacagcagagaaggaagtaaaaaggaagagatcgcatcctgaattggaaaatgtgaaaatctctgaaacaactgggaattcaaagtttagacctgatactagttccaaatcatcagatttgggatctgtaactgaatcagatattgactgtactgataatacaaaaaccaaaaggaggaaaacgaaaggaaaagcaaaagtagttagaaaagaatttgttcctagagacagagaacccaatacaaaagtgagaacatgtatgcataatcagaaggatgcagtgcagatgcctagtgaaactctgaaagcaaaaatggtacctgagaaagttccccgcagatgtgctactgttgctgcaaataaaataaagataatgagtaatctaaaagaaacgatctcaggaccagaaaatgtctggattaggaagagtagcagaaaactgccccatcgaaatgcttctgctgcggctaagaaaaaattactgaatgtttataaagaggatgatacaaccataaattctgaaagtgaaaaagagctagaagatattaatagaaaaatgctttttttaagggggttcagatcctggaaagaaaatgcacaatagtgactatgagaatgtagaagtggcatctgaaaacaattggtacacaagtaaactggcagttacattctgctcccagctctaaaattactcccttattggcatctttggaggaattttctaaaagccataatccagtgggttcctcccagtcagctcttgtacagacatgtgctctggggaattctgaggaggaaataaattgcagagtctgtaggtggagaggtggaaagaaaagacaaatggcctgctataagactactattcctttccagaatgcaaggccttgaagacatgattccttagaggaagaatataatgggaagtgtacaggctaggaagaacttgaagtgaacaaatttcaaaatcttaacctgatgctaattttcagggttctccattacagtgtaaaaattcagaccacgacaactatggtgtcatgaggaaaaaaaatcaggcatttttccaaaggaagtgctaatgggcctatttgacttctgagtgaagcaaaaactacccagatccattccctacaattcacatccccaaaggtcaaaaacaaactaggaggacctgggaatttcagctggagatactgattattgagttctgaagtagagtgttggaaataggcaattagagaaagtccattgatgtcattttgtttataatattgcagttcatactgaatgaccacttgatatgactaattcagggaatatatatttttctatgaaagctatgaatgttactatcacggcttttccttatttttacttgtatgtagcagcatttacagaaatgccaaaaatgtgcctcattaagaggcaggtcttaatcagttagataaaaataaaatgtatagcttaagatcaaaacagtcatatttttagatacagtgaaatcttttatgtttctctacagcaccttaaaaattagaacttgaatactttgagtaaacttactacaatctcatcccaacaaactttaatggtagcatgtttggcctatttcattgtggcctgtactaggattagaaaatttggtcgtggtataacaaagaagtgtatttacaataggatttaatttgttgttaatatgtatttgttgaaattaaaattgccagattaaatgaatatactgtcgcatctttttaacatagtaacgtgttactggaaaaattaagttgttgaaagtaagttgttttcccatttaaaaatatctgaatatatgatttgcatgtgtaaatctgaaaaactaaactacagaaacctagggttttctatttcttttttaagtcaaatgcatttttttttttttgttatacagatgaaccaagtgtctaaaatacttgagaaatttgtggttgcatgtctgttttaaaaaaaaggctttttgttttttagcataagccagaatattctaacctactaagtctgtgtcctttgctccttttgtagtatactttcatctaaattactgatccccaatatgttgatacacaggtgagaaagggaagaattcctaataaactgctattacttttaggtgcatggggtttgatttttgagctctaatgaaatgcttaaacttctttccagttcaaattttacacttaatttataatatttattgagtatattatgtcctcaacaagtaactataaaatgaaatacttaactcggtgaagactattttatgcaaagtttttttttttttttttttttttttttagcaatttcagtgtaatgaaagaatttaagctttgaatttataatttgctgtggtggggttaatttctgtcagtatttgagattgtattatcagtcttgcataatgaaatccttttttggctaagtatttaattcgaacatatttgcctttttaaaaagtgcttggcctaaacttattgtaactgcatgaaataagcatttgcttaaaacttaacattgtaaaattgttctctctgaaatgtgtgcagaatttaaatcatggccaaatgtattactattaccctatttacagtaatttgctttgcagaaaatatttcttcatcatggaactgtgaaatcaaattgaagatcttactggtaaaaatgacaaattaacaaaaggactaagacaagtggtgcccaaacaacctttttattctgcagttccatcatcataatagaccagttaacccaggagtcctaatgttttaaaacatcattgtggtgatcttgtttattctatctcactaaggatatccagtttcctaagctcttactggctagcaatttcgtcttaattttattgctaaatgttcaaattttgcttccaaactcactttatttttgcagatgtgtacatctgctaagtactaattttatgtaaatgattttgttgattatctttccacatcttaaaatgtttctaacagctttgagattttatctcaacaggctctctctgaccccaaagtagtacttaccttcgtgactactgacaaagtcacaaaatgcaggcgatgtcatgtatttcggtacaactaaatctaggaaacggttttttcattgcattactgcatattttcattttcatttaaattatgtcccctttttctcttgcttgaaacagtgctcctcgaactttgtcttccagcacattttaaagagaaccaattaaagaacaatcacacattctgcttattaaaggctatttaaaaagaaacattttgtattagaaaatggccaactttaaaacactattttttacactcataaaaatgttttttaaatcgccttgacaatcatcagcttttgaaatgtgaattcctattgccagagtaaaggtctcgtttttataccacca

SEQ ID NO: 1058 - DNA, 2986 bp, Homo sapiens
acacctcagttcacaatcctggggcgatatggcagaatcttttttttcggattttggcttgttgtggtatctgaaggagctcagaaaggaagagttttggaaatttaaggagctcctcaaacaacctttggagaaatttgaactcaagccaatcccctgggctgagctgaagaaggcctccaaagaagatgtagcaaagctgctggacaaacattacccaggaaagcaggcatgggaggtaacactgaacctgtttctacagatcaataggaaagatctctggacaaaggctcaggaagagatgagaaataagctaaacccatacagaaagcatatgaaggaaacatttcaactcatatgggagaaggaaacctgtcttcacgtccctgagcatttctacaaagaaaccatgaaaaatgagtataaagaattgaatgacgcatatactgctgcggctagacgacacactgtggtcctggaaggtcctgatggaattggaaaaacaacccttttaagaaaagtgatgttggactgggcagagggaaacttatggaaggacaggttcacatttgtgtttttcctcaatgtctgtgaaatgaacggtatcgcagagaccagcttactggagctcctctctagggactggccggagtcttcagagaagatcgaagacattttttcccagccagagagaattctgttcatcatggatggctttgagcaactgaagtttaacttacaacttaaggctgacttgagcgatgattggaggcagcggcagccaatgccaattatcctgagcagtttgttgcaaaaaaagatgcttccagaatcctctctccttattgcattaggaaaactggctatgcaaaaacactattttatgttgcggcatccaaaactcataaagctcttaggattcagtgaatctgaaaagaagtcgtatttctcctacttctttggtgagaagagcaaagccctgaaagtcttcaattttgtgagagataatgggccgctgtttatcttgtgccataatccctttacgtgctggttggtctgtacttgtgtgaaacagaggctagagaggggagaagaccttgaaataaactcccaaaacaccacctatttatatgcatcctttttaacaactgtattcaaagcaggaagtcagagttttccacctaaggtgaacagagcccgactaaaaagcctgtgtgctttggctgcagagggaatttggacatatacatttgtattttcccatggggatctccggaggaatgggttatctgagtctgagggcgtgatgtgggtgggtatgagactcctccaaaggagaggggactgttttgccttcatgcatctgtgtatccaagagttttgtgccgccatgttttatttgctcaaacgacccaaagacgatcctaacccggccattggaagcataacccagcttgtaagagcaagtgtggttcagcctcaaaccctcttgacccaggtggggatattcatgtttggaatttcaacagaagaaatcgtcagcatgctggagacctcctttggttttccactgtcaaaagacctaaagcaggaaataacccaatgccttgaaagtttaagtcaatgtgaagctgatagggaagccatagctttccaggaactattcattggtttgtttgaaactcaggaaaaagaatttgtaaccaaagtgatgaatttctttgaagaagttttcatttatattggtaacatagaacatttggtaatagcttcattctgcctgaagcattgtcaacatttaacgacacttcgcatgtgtgtggagaatatctttccagatgactcaggatgcatctcagattacaatgagaagctcgtctactggcgggagctttgctcaatgttcattaccaacaagaacttccagattttagacatggaaaataccagccttgatgatccctccctggcgattctttgcaaagcgctggctcagcctgtttgtaaactccgaaaactcatatttacttctgtgtactttggacatgattcagaattatttaaggcagttcttcacaaccctcatctgaaacttctgagcctgtacggcactagcctctcccagtctgacatcagacacctgtgtgagacgctgaaacatccaatgtgcaagatagaagagctgatactgggaaagtgtgacatctccagtgaagtttgtgaagacatcgcctccgtcctggcctgcaacagcaagctgaaacacctctccttggtagaaaatcccttgagggacgaaggaatgacgttgctgtgtgaagccctgaagcactcacactgtgccctggagaggctgatgttgatgtactgctgtctcacctctgtctcctgtgactccatttccgaagtcctcttgtgcagtaagtccctgtccctcctcgatctgggctcaaatgccctggaagataatggagtggcatctctgtgtgcagcgctgaagcacccaggctgcagcatacgggagctgtggttgatgggctgtttccttacttccgattcctgtaaggacattgctgctgttcttatttgcaatgggaaactgaagaccctgaaacttgggcataatgaaataggagacactggtgtcagacagttatgtgcagctttgcagcatcctcactgtaaattagagtgtctcgggctgcaaacgtgtccgatcacccgtgcctgctgcgacgacatcgccgcagcactcatcgcctgcaaaacactgaggagcctgaacctcgactggattgccttggatgctgatgcagtggtggtgctgtgtgaggcattgagccacccggactgtgccctgcagatgctgggaaattgtcagaagtccctcggagacacagttgcaccaggtgagaaccactgctctataaaacatcttctacttacgttgcccataaatatgcaacgccagctcagacttcagaag

SEQ ID NO: 1059 - DNA, 3299 bp, Homo sapiens
ccaggaagagagctgtgaccagcagcgtcccttattcgcttggccttggttcctgtttgcactggctacagcagggcactggcccctactgtcaccgccacctacacaaagaccctatctctgagcgctgcagcctactgttcagccccaggtttgaggatggatgccctggacgcttcgaagctactggatgaggagctgtattcaagacagctgtatgtgctgggctcacctgccatgcagaggattcagggagccagggtcctggtgtcaggcctgcagggcctgggggccgaggtggccaagaacttggttctgatgggtgtgggcagcctcactctgcatgatccccaccccacctgctggtccgacctggctgcccagtttctcctctcagagcaggacttggaaaggagcagagccgaggcctctcaagagctcttggctcagctcaacagagctgtccaggtcgtcgtgcacacgggtgacatcactgaggacctgctgttggacttccaggtggtggtgctgactgctgcaaagctggaggagcagctgaaggtgggcaccttgtgtcataagcatggagtttgctttctggcggctgacacccggggcctcgtggggcagttgttctgtgactttggtgaggacttcactgtgcaggaccccacagaggcagaacccctgacagctgccatccagcacatctcccagggctcccctggcattctcactctgaggaaaggggccaatacccactacttccgtgatggagacttggtgactttctcgggaattgagggaatggttgagctcaacgactgtgatccccggtctatccacgtgcgggaggatgggtccctggagattggagacacaacaactttctctcggtacttgcgtggtggggctatcactgaagtcaagagacccaagactgtgagacataagtccctggacacagccctgctccagccccatgtggtggcccagagctcccaggaagttcaccatgcccactgcctgcatcaggccttctgtgcactgcacaagttccagcacctccatggccggccaccccagccctgggatcctgttgatgcagagactgtggtgggcctggcccgggacctggaaccactgaagcggacagaggaagagccactggaagagccactggatgaggccctagtgcggacagtcgccctaagcagtgcaggtgtcttgagccctatggtggccatgctgggtgcagtagctgcccaggaagtgctgaaggcaatctccaggaagttcatgcctctggaccagtggctttactttgatgccctcgattgtcttccggaagatggggagctccttcccagtcctgaggactgtgccctgagaggcagccgctatgatgggcaaattgcagtgtttggggctggttttcaggagaaactgagacgccagcactacctcctggtgggcgctggtgccattggttgtgagctgctcaaagtctttgccctagtgggactgggggccgggaacagcgggggcttgactgttgttgacatggaccacatagagcgctccaatctcagccgtcagttcctcttcaggtcccaggacgttggtagacccaaggcagaggtggctgcagcagctgcccggggcctgaacccagacttacaggtgatcccgctcacctacccactggatcccaccacagagcacatctatggggataactttttctcccgtgtggatggtgtggctgctgccctggacagtttccaggcccggcgctatgtggctgctcgttgcacccactatctgaagccactgctggaggcaggcacatcgggcacctggggcagtgctacagtattcatgccacatgtgactgaggcctacagagcccctgcctcagctgcagcttctgaggatgccccctaccctgtctgtaccgtgcggtacttccctagcacagccgagcacaccctgcagtgggcccggcatgagtttgaagaactcttccgactgtctgcagagaccatcaaccaccaccaacaggcacacacttccctggcagacatggatgagccacagacactcaccttactgaagccagtgcttggggtcctgagagtgcgtccacagaactggcaagactgtgtggcgtgggctcttggccactggaaactctgctttcattatggcatcaaacagctgctgaggcacttcccacctaataaagtgcttgaggatggaactcccttctggtcaggtcccaaacagtgtccccagcccttggagtttgacaccaaccaagacacacacctcctctacgtactggcagctgccaacctgtatgcccagatgcatgggctgcctggctcacaggactggactgcactcagggagctgctgaagctgctgccacagcctgacccccaacagatggcccccatctttgctagtaatctagagctggcttcggcttctgctgagtttggccctgagcagcagaaggaactgaacaaagccctggaagtctggagtgtgggccctcccctgaagcctctgatgtttgagaaggatgatgacagcaacttccatgtggactttgtggtagcggcagctagcctgagatgtcagaactacgggattccaccggtcaaccgtgcccagagcaagcgaattgtgggccagattatcccagccattgccaccactacagcagctgtggcaggcctgttgggcctggagctgtataaggtggtgagtgggccacggcctcgtagtgcctttcgccacagctacctacatctggctgaaaactacctcatccgctatatgccttttgccccagccatccagacgttccatcacctgaagtggacctcttgggaccgtctgaaggtaccagctgggcagcctgagaggaccctggagtcgctgctggctcatcttcaggagcagcacgggttgagggtgaggatcctgctgcacggctcagccctgctctatgcggccggatggtcacctgaaaagcaggcccagcacctgcccctcagggtgacagaactggttcagcagctgacaggccaggcacctgctcctgggcagcgggtgttggtgctagagctgagctgtgagggtgacgacgaggacactgccttcccacctctgcactatgagctgtgacaaggcagccaccctgtcacctagctcaatggagccccggatcccaagccctgcattgtaagcccacagtaggcactcaataaatgcttgttaaaggaagg

SEQ ID NO: 1060 - DNA, 1350 bp, Homo sapiens
atgcacacatacgcgcgcgcacatgcacataggcacacagagatacgcgcacacacacacacaaacgcactcagatttcccggaccctggttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgagcttcaggatggttcgtactaagacatggaccctgaagaagcactttgttggctatcctactaatagtgactttgagttgaagacagctgagctcccacccttaaaaaatggagaggtcctgcttgaagctttgttcctcaccgtggatccctacatgagagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggtatgtaa

SEQ ID NO: 1061 - DNA, 2230 bp, Homo sapiens
caggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgagccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgtta

SEQ ID NO: 1062 - DNA, 3462 bp, Homo sapiens
ctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctcctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcaaaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaa

SEQ ID NO: 1063 - DNA, 1595 bp, Homo sapiens
gcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctctgtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtaga

SEQ ID NO: 1064 - DNA, 4968 bp, Homo sapiens
agccgcgcccgccagcgccctcggtgggcacagccacccggagcggcgcgggtgccgggagctgggcgacgcgcccctcctgccccggctgcgctgttgcccgggcggccgacctccgtgcgtgagcgccggcaggcaccttgcgcgcgcggaacctgctgacatggccaagcatggagccgacgagccatcctccaggtcagggagtccggacagggaaggtagggcctctgaggacagatcgctgcttcatcagaggctggctgtccgggagctcatcgacactgaggtctcctacttgcacatgctccagctctgtgcctctgacatcaggagccgcctccagcagttgccgcagggagatctggatgtcctgttctcaaacattgatgatatcatcaaagtgaacagcagattcctccatgatctgcaggagacagcctccaaggaagaggaacaagtgcagctagttggtaacatatttctggaattccaagaggagttggagcaagtctataaggtctactgtgccagctacgaccaggccttgctactggtggacacgtaccggaaggagccggagctgcagcggcacatccagggcatcgttgaggcggtggtgccgcaagctggatcttcaggcctcagtttcttgctggtaattcctctgcagaggatcaccaggtacccactgctgctgcagaaaatcctggagaacacagtccctgatgccagtgcctatcctgtccttcagagggctgtctctgccctccaggacgtgaacaccaatatcaatgagtacaagatgcgcaaggaagtggcctccaagtacaccaaggtagagcagctgaccctccgggagcggctggcccgcatcaacacacacaccctctccaagaagaccacccggctgagccagctgctgaagcaggaggcggggctgatccccaggacagaagacaaggaatttgatgatttagaagagaggttccagtgggtgtctctgtgtgtgactgagctgaagaacaacgtggctgcttacctggacaatctgcaggctttcctctacttcaggccgcacgaatacaatctggacatccccgaggggcctgcagtgcagtattgcaatttggcaagagaccttcaccttgaggccttcctgaaatttaagcaacggctagaaggcctggtgtggcagccactgtgcagcctggccaaagccctgcttggccctcagaacctgatcaagaagcgtctggacaagctactggactttgagcgggtggaagagaagctgctggaggtgggcagtgtgacctaccaggaggaggccgcccggcacacataccaggcactcaactcgctgctagtggctgagctcccacagtttaaccagctggtcatgcagtggctgggccagatcatgtgcacattcgtgaccctccagagggaccttgcaaagcaagtgctgcagagggcagagggaagcatggcccagctgccccaccaccacgtcccagagcctgccttcaggaagctggtggaggacgcactgggccggacgagtaaccagcttcgctcctttcaagagacctttgagaaagtgcagccacctcccaccacacaaccgctccttccagggtctgaacgccaggtgcaggctctcctgagcaggtatggccctgggaagctgtaccaggtgacaagcaacatcagtgggactgggactctggacctgactctgcctcggggccaaatcgtggccatccttcaaaacaaggacaccaaaggcaacagcggccgctggctggtggacaccgggggacatcgtgggtatgtgccggctgggaaactacagctgtaccatgtggtccccagtgcagaggagctcagaaggcaggcggggctgaacaaagacccccgatgtctaacaccggagcccagcccagctctagtgccctctattcccaccatgaaccaggtcatagccgcgtacccttttgtggccagaagcagccatgaagtgagcctgcaggcaggccagcctgtgaccatcctggaggcccaggacaagaaggggaaccctgagtggagcctggtggaagtgaatggacagaggggttatgtgccttctggcttcttggccagggctcggagcccagttctgtggggctggagtctgccctcttagggtaccctctttggagcctacattgccaaatgatgggggaggcttagaggctctgaccctggggggaaaagaagcaaaggaaaggtggaggtggaagggaagaccaggccagggtgggtgaagcacactcaggaggcagccagaagacatgggcgggcctcgcagagtgcttggtgtggtgggggcacaggaggctccagccaggactgctcattatgtctgcataaagaactcattccgacctggggtcacaatgcacttggacagcaggtcacagctgattggccaggactctccataggttatggccagtcttagctgtgcctgcatccgggcctgcctgtgggcgtgggtcacacgggataatgttacctgcgtgctgtgtggttgcaggaagcgggttctggaggagtccagaactgcctggtcagacagttcacttcctacacatggtatcaggagacatcataaccaatgagtcagcttttatttctctatgctggaagctgagtttatcttgggcagtgacccactgggagccctctcaagtggggaagccatggatttatcggtgtagcagagaggttcccaagactcttgactggtcctgggagtgggtgtgaccaagtcatagttctggaatgtgtgtaggcaaattcagaggctgttccagggaagaggggattttgatactgtgttaggtggggtgtgtgaggctgttggcagcaggtgaacagctactgctgtgttctcaggactagggaacaaaggggtatgcaaatcatagaggaaactctgggaaggcggtgataaggcctggtgggtggggaggttagggaatggcttgctttcctgtttctggttagaaggggagccagggggaacccccagtggtttcaggtggcccctgaggtcctggaggcagccgtggatgtgatgcaattggctgtgggaccttagatgtaggacacaacttcagtgttcccatccagaaagacctcactcacagggttgtgctgagaatgacgtggggctaagcatgcagagctccctgtaaactgtgaagtgtgatacaaatgtaaatgacagcagtgatctcggggtggcccccggcatgctgccctcccccacgcccatgcctgtggcagcaaaccttgttcatcagtatagctttctttcctgtaacccaggatctaccttggggggcttctcaatactgcattctatgtagccagcctctttaacttggtaagtgagccaccccattctagaacctggaaattggagcccctcaaaaacagttcctgttcaaggaggactgacctgctggggcaatgttgggtgcagtgcagtccctgcttggggtggtcatgtctaggctgttgctctgggcaaagataagttgcaagattcacagaaatgggaaaatgtgaccaagtgtgatcttaacaactgacaaagtttgtaaccaacccaagttagaatgtgtgtcaaacaggaggtagtttagatatgcttccaagaacatgtctgtgttataaccatagtgcctaagcagtgagctctggtttttgaagggcttttaagaaatatatacatgtctgtgtcagtctataacttgcctcctctgggcctgttaaagcatgaagactgcatgacacaagagaaatgcaagccctacggttcctttctcagcagcgaattcacttgagaggatgctcttgactcattctctctgctctttcctgctcagatttctgataaaaatagagagcataggggaacagataatgaaataggaaacccactcgtgggttccacagatacctaccgaaggcctactgtgtgctagaattgtagctcaggagttctcagtgtagctgctcactgaagttaccatggcaggtttcaactggcagaatccaggctccgtcccacccagagattctgatgaaattggtttagggtgtggctcgggcctcaggaattcagaaagcttcccaggtgcttccaatgtgcagccagggttagggacctctaccctagacacaaagtattggacagatagacctggtgccagagatggccatgagctgtaagctaggacgtgccccacctgagctctgcactagctagttcaaacaggcgctttaaaggcagtgtgaaaggggacagcctgttctgccaggtctcagaatgtatatttattaagtgccattaaaagggacctgaacaaaattggatgtcttgtaggcataagggaggaaaataaaatatacttggaaccaagtctatgtcatgaagggaaaataaaaatgtattcagtagcacgtgggttatggtttctcatagaccaggggataagattaaaagtcactgaagagtgggaaaatgcatgttgagaagatgagaatggcctgtattttctccaggggaatctgtgtaatgtgccttttccctctccaaatgcctagaaccatggcactgtgtcttatttatttaaccgttgggctgtctcatactaaacttgcaaagatatttgcctatgaactgaacaagacttccaggagttgaagtctggttcacaagggtaccccttgcctcctgtgatggagtgagaactcttaaacccctcaggccccaactcagttgtggagatgaggacaagattacaatatcaaaagaaagatgaatgaattcttggttaatatgacgaaccccagctcaatgagtaactgatgtgaactgctgggaataaaggacttcaaagatggaaa

SEQ ID NO: 1065 - DNA, 3795 bp, Homo sapiens
gagttccgtattctagttctgtgtgatctgatctttaccttcccttccttggatccctgtgcacctactggagccaggttactctgggtcctggacctgactgcctcattctggaggcttccagacagccacagttagtgcccaaacctgagaggatggcttcagatggagcatctgcattgccgggaccggatatgagcatgaaacctagtgccgccccgtctccatcccctgcacttccctttctcccaccaacttctgacccaccagaccacccacccagggagccacctccacagcccatcatgccttcagtattctctccagacaaccctctgatgctctctgctttccccagctcactgttggtgacaggggatgggggcccttgcctcagtggggctggggctggcaaggtcattgtcaaagtcaagacagaaggggggtcagctgagccctctcaaactcagaactttatccttactcagactgccctcaattcgactgccccgggcactccctgtggaggccttgagggtcctgcacctccatttgtgacagcatctaatgtgaagaccattctgccctctaaggctgttggtgtcagccaggagggtcctccaggccttccgcctcagcctccaccaccagttgctcaactggtccccattgtgcccctggaaaaagcttggccagggccacatgggacaaccggggaaggaggtcctgtggccactctatccaagccttccctaggtgaccgctccaaaatttccaaggacgtttatgagaacttccgtcagtggcagcgttacaaagccttggcccggaggcacctatcccagagtcctgacacagaagctctttcctgttttcttatcccagtgcttcgttccctggcccggctgaagcccactatgaccctggaggagggactgccattggctgtgcaggagtgggagcacaccagcaactttgaccggatgatcttttatgagatggcagaaaggttcatggagtttgaggctgaggagatgcagattcagaacacacagctgatgaatgggtctcagggcctgtctcctgcaacccctttgaaacttgatcctctagggcccctggcctctgaggtttgccagcagccagtgtacattccgaagaaggcagcctccaagacacgggccccccgccggcgtcagcgtaaagcccagagacctcctgctcctgaggcacccaaggagatcccaccagaagctgtgaaggagtatgttgacatcatggaatggctggtggggactcacttggccactggggagtcagatggaaaacaagaggaagaagggcagcagcaggaggaggaagggatgtatccagatccaggtctcctgagctacatcaatgagctgtgttctcagaaggtctttgtctccaaggtggaggctgtcattcaccctcaatttctggcagatctgctgtccccagaaaaacagagagatcccttggccttaattgaggagctagagcaagaagaaggactcactcttgcccagctggtccagaagcgactcatggccttggaagaggaggaagatgcagaggcgcctccaagtttcagtggcgctcagttggactcaagtccttctggttctgttgaggatgaagatggggatgggcggcttcggccctcacctgggcttcagggggctgggggcgccgcttgccttggaaaggtttcttcttcaggaaaacgggcaagagaagtgcatggtgggcaggagcaagccctagatagccccagagggatgcacagggatgggaacactctgccatcccccagcagctgggacctgcagccagaacttgcagctccacagggaactccgggacccttgggtgtggagaggagagggtctgggaaggttataaaccaggtatctctacatcaggatggccatctaggaggcgctgggcctcctgggcactgcctggtggctgataggacttcagaggctctgcccctttgttggcagggaggcttccagcctgagagcactcccagtttggatgctggacttgcagagctggctcctctgcaaggacaagggttagaaaagcaagtcctgggattgcagaaaggacaacaaacagggggtcgtggagtgcttcctcaagggaaggagcctttagcagtgccctgggaaggctcttcaggagccatgtggggagatgacagaggtacccccatggctcagagttatgatcagaatccttcccctagagcagctggggagagggacgatgtctgtctcagcccaggagtttggctgagcagtgagatggatgctgtaggcttggagctgcctgtacaaatagaggaggtcatagagagcttccaagttgagaagtgtgtaactgagtatcaggaaggctgccagggactgggctccaggggcaacatttccctgggtcctggagaaaccctagtacctggggatacggagagcagtgtgattccctgtggaggcacagttgcggcagctgccctagaaaagagaaactattgcagcttgccaggacctttgagggccaacagcccacccttgaggtccaaagaaaatcaagaacagagctgtgaaaccgtagggcatcccagtgatctgtgggcagaaggttgcttcccattgctagaaagtggtgattccacactggggtcttccaaagaaacccttccacccacatgccaaggcaatctccttatcatggggactgaggatgcctcctccttgcctgaagccagtcaagaggcagggagcagaggcaattccttttctcctctgttggaaaccatagaacctgtcaacatactagatgttaaagatgactgtggcctccaactaagggtcagcgaggacacctgcccactgaatgttcattcttatgacccccaaggagaaggcagggtggatcctgatctgtccaagcctaaaaaccttgctcctttacaagagagtcaggagtcttacacaactgggactcccaaagcaacatcttctcaccagggccttggaagcactttgcctagaaggggaaccaggaatgccatagttccgagagaaacttctgttagtaaaacacacaggtcagcagacagggccaaaggaaaggagaaaaagaaaaaggaagcagaggaagaggatgaggaactctccaactttgcttacctcttggcctctaaacttagcctctcaccaagggagcatcccctcagtcctcaccatgcctcaggaggtcagggcagccagagagcatcccacctgctccctgctggagcaaaaggccccagcaaacttccatatcctgttgccaagtctgggaagcgagctctagctggaggtccagcccctactgaaaagacaccccactcaggagctcaacttggggtccccagggagaaacccctagctctgggagtagttcgaccctcacagcctcgtaaaaggcggtgtgacagttttgtcacgggcagaaggaagaaacgacgtcgtagccagtagggagcagcgggaccatctgaccccacttgccagtccctaaaggtgggtgccccagagtagattccacccctgctgcccaccaatggagaatcccaatgttgaatctcatcccaatgttgttttgttgttctgcaaaagtggcaagcatggagagagaggtcagactggctaggctgcagggggaattacctttggaaggagctatatagaaaaaaaatgaataaagtgttttgttggaaaa

SEQ ID NO: 1066 - DNA, 997 bp, Homo sapiens
gcagagaacgaatacgctccgttttaattcagtggcctgggctacatgggatatttaggacagactatctctctgagacagaaaaacaagggaggaggcagtatgaaagaatgtattctcgctaaattccagtttctaaaggatgtgtaagaaaccagaggtaaaggtctcgcgatatcttaagacatccggcgtagtacgcttcagtgagccacagcgctagagaagtaggagaagctcgcgagatctgtgccgttgccgaggagactaggagggggaggagaggggatctcgcgaaaggaaagaggtcgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggttagcacgggctctggttctgggactgaggggcagtcaagcagcaagatggagggggtggggaactgcagctcccggcagcctctgggctttgtgtgagtgccccgcgggctgccgggagctgtggttccgcgggcgggcagcctgggctgcgcggtctgagcgcttgttacaccccgcgcaggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccg

SEQ ID NO: 1067 - DNA, 1161 bp, Homo sapiens
aaactcaagaactttactctcttggaaacccaaatagatccttcaccctctgacaccatggtcaactcctgttgtggctccgtgtgctctgaccaaggctgtggccaagacctctgccaggagacctgctgctgccccagctgctgtcagaccacctgctgcaggaccacctgctaccgccccagctacagtgtgtcctgctgctgcagaccccagtgctgccagtctgtgtgctgccagcccacctgctgtcgccccagctgctgtgtgtccagctgctgcaagccccagtgctgccagtctgtgtgctgccagcccacctgctgccaccctagctgctgcatctccagctgctgccgccccagctgctgtgtgtccagctgctgcaagccccagtgctgccagtctgtgtgctgccagcccaactgctgccgccccagctgcagcatctccagctgctgccgcccctcttgctgtgaatccagctgctgccgcccctgctgctgcctgcgtccagtctgtggccgagtctcctgccacaccacttgctatcgcccagcctgtgtcatctccacctgcccccgccccgtgtgctgcgcctcctcttgctgctgagcccactgccctggctcatctctcccttcaccgctggtccacaaatgtagaccattcttctgtgctgaatattaggacacatggagtgggatttatgtcattcagcagggtggacctcatgtatccaatgagcccatcaccatcccgctgactctgtgagaacattctggttcattttaaactccctcccttgctttctttttcttccagtcatggcaccaaatacgaattaatttgtaatccactagctaagaaattattccaatcctctaaattcctcattttttaaaatcattttgagcctacagaatatccttcccaattaggtacacattatctccctttcaaacatactatttgtctgtcagcctttcagtcattcttttcttttggaaaggtaggaggctgcccctcccgtgctctcccgctttctccctgctctctctttctctcactgttcaagtttgtcagaatttttctattttattagttctttatctttattgtgttcacaaaatatattgtattaaacttttcatttagaaa

SEQ ID NO: 1068 - DNA, 440 bp, Homo sapiens
cacctcaactgaaatctaacctcctgaaatcatgtgttgcaactactacagaaactgctgtgggggctgtggatatggctctggctggagttccggctgtggatatggttgtggctatggctgtggatacggctctggctgtagatatggctctggctatggaactggctgtggctatggctgtggatacggctctggctgtggatatggctgtggatacagctctagctgctgtggctaccgaccactttgctacagaagatgctattcctcttgctactaatcatcactacaggtcatccttggctttgcaatgacctctccaagatcaagttcaattgaaatctcccctacccattatcttcacatctaagtaaaggttgactatggtcacctgactatctgaatgcatataagagaagctgttggcagtggatgga

SEQ ID NO: 1069 - DNA, 1281 bp, Homo sapiens
aacagggcttcgtcttctttgcagagccatgggcagcaggaagaaggaaattgccctgcaggtcaacatcagcacccaagagctttgggaggaaatgctcagttccaaaggactaactgttgttgatgtctatcaaggctggtgtggcccctgcaaacctgtggtgagcctcttccagaagatgaggatcgaggtcggcctggaccttctgcactttgcattagcagaggcagatcgtcttgatgtcctcgaaaagtacagagggaagtgcgagccaacctttctgttttatgcaggaggagaactggtggctgtggttagaggagcaaatgccccactgctgcagaaaaccatcctagaccagctggaggccgaaaagaaagtgctggctgaaggcagagaacggaaagtgattaaagatgaggctctttctgatgaagatgaatgtgtttcccatggaaagaataatggtgaagatgaggacatggtttcatcagagaggacctgtaccttggccatcattaaaccagatgcagtggcccatggaaagactgatgagattatcatgaagattcaggaagctgggtttgaaattctaacaaatgaagagagaaccatgacagaggcagaagtgcgacttttctaccaacacaaagctggagaggaggcatttgagaagctggtacatcacatgtgcagtggaccaagccacctcctgatcctcaccaggactgagggcttcgaggacgtggtcactacctggcgaaccgtcatgggcccccgtgaccccaatgtggccaggagggagcagccagaaagtctccgagctcagtacggcacagaaatgcccttcaatgccgtccatggaagccgggacagagaagatgctgacagagaactggcattgctcttccccagtttgaaattttcagacaaagatacagaagcccctcagggcggtgaggctgaagcaacagcggggcccactgaggcgctttgctttcctgaggatgtggattgagatggctgtgctgctcttccagagcacgtgaccaggggtctactgcacaaaacagacctccggaatcggaacttactcttttgagtaccaatactttttggtttagctgtcttttgtagacaatgaaaataatatggctgggcgcagtgactcacacctgtaatcccagcactttgggaggccgaggcaggtggatcacctgagattaggagtttgacaccagcctagccaacatggtgaaaccctgtctctactaaaaa

SEQ ID NO: 1070 - DNA, 606 bp, Homo sapiens
atggtcagctcctgttgtggctccgtgtgctctgaccagggctgcggccaagacctctgtcaggagacctgctgccgccccagctgctgtgagaccacctgctgcaggaccacctgctgccgccccagctgttgtgtatccagctgctgcaggccccagtgctgccagtctgtgtgctgccaacccacttgttcccgccccagctgctgtcagaccacctgttgcaggaccacctgctaccgccccagctgttgtgtgtccagctgctgcaggccccagtgctgccagcctgcgtgctgccaacccacttgctgtcgcccccctaggtgctgcatctccagctgctgtcgccccagctgctgtgtgtccagctgctgcaagccccagtgctgccagtctgtgtgctgccagcccaactgctgccgccccagctgcagcatctccagctgctgccgcccctcttgctgtgaatccagctgctgccgcccctgctgctgcgtgcgtccagtctgtggccgagtctcctgccacaccacttgctatcgcccaacctgtgtcatctccagctgcccccgccccttgtgctgtgcctcctcttgctgctga

SEQ ID NO: 1071 - DNA, 1036 bp, Homo sapiens
gcggggcggcggggcggccggcggcggccatgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccataactaaaaatcacaaagactatcctttccacatagaatactgaggacgcttccccttccttgtttctgctcagcccagatgcacagacactattggcaatgttgaccctcctctgtcatcacagcgccagggcagctgtgcctgggacaggagccacacagtcagagggggatgtaagagccaccttctctgacaaatctggagaattgagtgtgttctaagtgaaggcaatggggtttctccaagacagcctgtgtg

SEQ ID NO: 1072 - DNA, 330 bp, Homo sapiens
gcattgaactgaatctctagtccctgacaccatgagatactatggcagctactacagaggcctgggatatggctgtggaggctttggtggtctgggctatggctgtggctgtggaggctacagatatggctctggctatggaggctatagatatggctgctgccgcccatcatgccgtgaaggatatggattctctggattctactaaaaaacttgctgattctcatactctaactccaagatcttgcccgtatgcttcagcaaggcgaacacttttctcaatgtagagaaaatacctaccattttttggcttcatgctccagaaggaac

SEQ ID NO: 1073 - DNA, 394 bp, Homo sapiens
gcaaacccaactcactatctctgacaccgtgagctactagggcagctactgtggaggtctgggctatggctgtggaggctttggtggcatgtgctatggctacggctgtggatgtggcagcttctgcagactgggctatggctgcggctatgaaggatgcagatatggttgtggccacagaggctgtggagatggctgctgctgcccatcatgctacagaagatatagattcactggcttctactaagctgctgctctagtgatgcagcatctgttattttgaagggatttaaaaacaagttacttacttctaagatacaatgggggtaaaggtgtaaatgtgtaaatgctcccattccaaagggagaaattgaccaaaacaaaggggctataa

SEQ ID NO: 1074 - DNA, 310 bp, Homo sapiens
aacaactcaccactcctgacgccatgagctactatggcagctattacagaggcctgggctatggctgtggaggctttggtggcctaggctatggctatggctgtggatgtggcagcttccgcagactgggttatggctgtggctttggaggcaacggatatggctactgccgcccatcatgctatggaggatatggattctcaattctactgaaatcctaccctgaggacacgatatcagaggtcataagaagatcattcaatttaaccaaatattgagtcaaacaagggcacactagatcaatccaaga

SEQ ID NO: 1075 - DNA, 494 bp, Homo sapiens
atgagctactacggcagctactatggaggcctgggctatggctgtggaggctttggtggcctgggctatggctatggctgtggatgtggcagcttccgcagactgggttctggctgtggctatggaggctacggatatggctctggctttggaggctatggatatggctctggcttcggaggctacggatatggctgctaccgcccatcatactatggaggatatggattctctggattctattaaactactgccccagcaacacaatgtgtgaaattataagaggactttcccagagctgacttcaatcattggacaacaaagatcatgctggagctatttgcacaaaagaatttaacatctcagaatttcaggcaattttttttctctgtatacccacatctctataataatcctagtattctctacttttgcttttaaagctgattgaattatctgtttatcttccaataaaacattctattttcaaacac

SEQ ID NO: 1076 - DNA, 474 bp, Homo sapiens
cacacacgctcctcactgcaaatcacctgagctcagaactcctgttaacatgtcttacaactgcagctctggaaacttctcctcctgctgttttggaagttacctgaggtatccagtttccacttataatttgttctaccccagcaatgccatctattctccaaatacctgccaactgggctcctctctctacaatggctgtcaggagacctactgtgagcccaccagctgccagacatcctgcactttggccagatcctatcagacatcctgttactgcccaaagaattccatcttctgcagtccccgccagactaactacataagatcccttggatgtggaaacactggccttggatctcttggttgtggaagcactggcttccaatctctggactgtgggtccagcttctaccacccaactaccttttcatccaggaatttccaggcaacttgttactaaccagcctttgg

SEQ ID NO: 1077 - DNA, 645 bp, Homo sapiens
tgaactcccatctctcatcagcatgtcctacaactgctgctctagaaacttctcctcccgctcctttgggggctacctgtactacccaggctcctaccccagcagcctggtctacagcactgccctctgctctcccagcacctgccagctgcgttcctctctctacagggactgtcagaagacctgctgggagcccgccagctgccagaaatcctgctaccgccccaggacctccatcctctgctgtccctgtcagacgacttgctctggatctctaggctttcggtccagcagctgtcgctcccagggctatggatctaggtgctgctactcgctgggaaatggatccagtggcttcagattcctgaaatatggaggctgtggttttccttccctgagttacggatccagattctgctacccaaactacttggcttctggagcctggcagtcttcttgttacagaccaatctgtggatctcgcttctatcaattcacctgctaaatttctagatccttttgagtattgggatcaaagtctctactgaatgcagccattattttcattcttgccagatcccaatatctttttattcttccaccaccagcttcttgcatgaccaacttctggcagactgcgaaatt

SEQ ID NO: 1078 - DNA, 932 bp, Homo sapiens
ctctattacctgcaagcaggagcagtggccaactcctggaaacagctctgccccaggttgcactctcgccctttgttcaagacaatctccgggaaggggcagagcagaaggtggtattcatcacaggacgagtccacccaggggaaacaccctcatcatttgtgtgccaagggatcattgacttccttgtaagccagcaccctattgcctgtgtcctccgggaatacctggtcttcaagatcgcaccaatgctcaatcctgatggagtctacctgggcaattacaggtgttctctgatgggatttgatctgaatcgtcactggctggatccctctccatgggtccatcctaccctgcatggagtgaaacaactcatcgtccagatgtacaacgacccaaaaacaagcctggagttttatattgacatccatgcccactccaccatgatgaatggcttcatgtatggcaacatctttgaggatgaggaacggttccagaggcaggccatttttcccaagctcctctgccagaatgctgaggacttctcctattccagcacatcctttaaccgggacgctgtgaaagcaggaactggccgtcgcttcctcggtggactcctggaccacacttcctattgctacaccctagaggtctccttctacagctacatcatcagtggcaccacggctgctgtgccctacactgaagaagcctatatgaagctggggcggaatgtggcaagaacctttttggactattatcggctgaaccccgtggttgaaaaggtggcaattcccatgccgagactgcggaaagaaaaatcccctccttacaagcacccactcctgcggggcccagccagcaactaccccaacagcaaaggggacaagaagagctcagtgaaccacaaagacccttcaacccctttttaa

SEQ ID NO: 1079 - DNA, 966 bp, Homo sapiens
tctgaacagaagcccaccctctacccctgacaccatgacccactgttgctccccttgctgtcagcctacatgctgcaggaccacctgctgcaggaccacctgctggaagcccaccactgtgaccacctgcagcagcacaccctgctgccagccctcctgctgtgtttccagctgctgccagccttgctgccgcccaacttgctgtcaaaacacctgctgccagcccacctgtgtgaccagctgctgccagccttcctgctgcagcacaccctgctgccagcccacctgctgtgggtccagctgtgaccagagcagctcctgtgcacctgtgtactgcagaagaacctgctactaccccacaactgtctgcctgcctggttgcctaaaccagagctgtggctccaactgctgccagccctgctgccgcccagcctgctgtgagaccacttgcttccagcccacctgtgtgtccagctgctgtcagcctttttgctgctgatcaagtcccaagagaaccaccatcctcacacaacaactttctgctcaactgacttatcttttgggggactaatttaatttgctgctgacagccaccatgctctcacccaaatttttatgaattctctacctgtttaaaatcttgggaatctacttgagggagggcagaatacttcatcctgattctctttttccttacactttgtggatcatgtgccagcttcgtgtgttctcaattttgagtcatggtctcagctttgactcaaaagtcaagagcttcattctctgcttctaaggaatttaggtttctgcaactgatcaataatctttgcaatcatatttttgttttcaatatcctcctcatggttcttgtatccttctttcttcttttcataactttgggttatgtttctgctaccagcagagattcttagctatatgtttctgaataaactctgaaccatcctc

SEQ ID NO: 1080 - DNA, 7289 bp, Homo sapiens
aaagcgtcctgggtattgtagtgtattggagggaaggcgtcttggcgccttctcttcgcaccgttttccggagactgttagaggaagagtcgctttttcctgcctcccaggctgcccagcggcgccggttgccggggaacgcaggcgccgtggggagggatggcgggaggatactgcttaggtgctggagacggagttgagctggtgaagaagagctcgggctcatcatgaaacaacgaaaaggccaagggtctgggggcagccgtgggcgcaaaaaaagaggtttaagtgacatttctccatctacaagcctgccacctctggttgaaggccagctacgctgttttctaaaacttactgttaatagagtcatatggaagattgcaaagcctcccacttgtgtacttgtccgagtgagatggtggggagaaacatcagatggaaccctcttttgtcccagggatgcattgcagactgaaccaaaagctgtgagaacaactacacgttacgctattcgttgtggtccaaaacagtttacctcttatctaacagatatggctgtgctggtgctggaagtaatcaccaaacttgatggtcttccaattggtagagttcagatcaatggactagctcaactttctccaacccatcaaatcaatggattttttaccattgtttcatcaacgtctaagaaacttggagaactccaggtctcacttgccctggaacctctgtcagaaacttacgacagctaccatccacttcctaccactgacatgacagaaaatgtgcttttatctaagcagggattcagagagaatactgaacccagcagtacccagtttcaggttccatcaaggcctcgcgacatacataccatcaaaattgatggaaaagagttagcagccaacagcagtagatcaaccactccgaggggaaaagaccatgtatgctttgcagagaaccctgatacaataaaggattcttcctttggactacagcacagtcttaattcaggacagagtttagagtctgtaactctgaaaggcagagctccacggaagcagatgtcccttctgaacagttctgaattccagcctcaaattagaacagttgccaagagtcacagtgactcatgcattctttcttcaaacaacctccctaccaaggatcttctttcagctctgttagaacaaggcaataaactgcgtaatgccatggtgatttctgcaatgaaatcaagcccagagaccagcatgttgttggaccaagttcatcctcctattaatgaagattctcttagagcatcaacacagatcagagccttttctaggaatcggtttaaagaccacattgaagatcacctcctcccttcaactgagaatacattttggagacatgacacaaaagctgataccagagctatacagctgctattaggcagtgctgaattatcccaaggcaatttctgggatgggctaggctctcctccagattccccatctcctgggagtgatgtgtattgcatcagtgagctgaatgaccctcagtatgaccagagtcttctggagaatttattttatacagcacctaaatctgataccagcatcagtgatttcctcagtgaagaggatgatatcgtcccttctaaaaaaataagccagtcaacagctcttgccagatcatctaaggttctggagtcaagtgatcataagctgaagaagaggtcagcaggcaagagaaatagaaatttggttgaacaacagatgctctcagaaactccagaagatgcccaaacgatgacactaagtgtggatagactggcccttttgggtagaacacattcagtcagaatcatcatcgaaaccatgggagttcctccagatagtcctcagatgacccctggcaaaaaaagctatgctggtccaccacctaaggtgactacagcaaaaaagcgcactttctttgtagaatatcactttcctgtgggcttttcggaaagcggattgggaaagacagctttgatcactgaggttgttcgactcgcctccagtaaaattacagatggaaaggtgaagttccagcagcgatttgtgtttccagtacagtttggtggcccaatgatagagcactggtggaattccaacctcactttccaaatttatgtaaagaaaactccacagaaaaagccagaagtcattggatctgtgtcactttctttgcgagctgtcattcaatcagagctgctttctttcagtgatcagcttccagtgcaacaagaaaatggtcagtctccatttggccccctcaaggtaaccatggagcttattacagataacaaagatttcactggtatcaatactaagttaagtggcaacacccattataccccactttgtgctcctacaagtccaaataaggcactaccagaacttaaccaagatatgacctgtaccaaaaatccacaaaacttaaaccaaattcatgaggaaactgcaaagaaagcacagaacttggtgctccccaaccgaaagtcaccaagccctgtagcaccacatccttcaaccttcgtagctacgccagcctcccataatttagtcaatcagacaaatgggacaacaaaagagagtgctttgctgttgcatgtgctgttgatggtgccagatgggaaagattttattagtggagaatctgagaaacaatcaccatgcaatgtttatttaaattgtaaactcttcagcacagaggaagtcaccagatctgtcatcgcatggggcacaacacaaccggtctttaacttttctcaggtgattcctgtctctctgtcttccaaatacctggaaaggcttaagaacaatgtgatggtaattgaaacttggaataaggtgcggagcccaggacaggacaagctgctcgggctggtgaaacttcccctccaccagttttacatgtcattcaaagatgctaagatttctcgcctgctgctggatgcccagtacccagttgttgctgtcgacagctacatgcctgtgattgatgtgttttcaggccaccaaaatgggagtcttcgagtctttttagctatgggttcttcaaatcaaataatggcactacaaagattaaagaatgaagaaggaacactccctcccttcagccctaggccagcccatttcctggaccagccaactgcagcatctgttgctatggcagaggaccgaggaaatggactgatggagcactgctttgagatccatatagagatggttaaagggctagcccctcttcaggcaacagtctggggagaagcagattgttatgtccagtactactttccagttcaacactctcaatccagtgtgctgaaaggacctgagttccttgaaaatggaattactctgaagcccttcagaactgcaaccacactctgtgttccagatcccatctttaatagtgaacaccatcactctctcctgttgccagctgaggttccagtgcaaaggctcctactaagtgctttctctgcacagggcctcgtgcctggaggtggagtccagtttgaaatctggtgcagatactattatcctaatgtgagagaccagaaggtcgccaaaggaaccttgccattatcaaggatctgtgctatggtaaccacccagcatcgtgaggatgtgggaatacagacctttaatctccctttaacccccaggattgagaacaggaaagaattgaggaaccagtcatcaggtttactggatgtgggcctaaggtacaggcgtagtccaagaacagcagagggagttcttgctgcccgaactgtttccatctcagtccagattatcagagcctgtggtctgcaagcagcagccaaggctttggctgaacgggaacccgctctacagtttagtgccacagtcggggtcaatgcctctgtcaccactcatctctccttcctgccccagggagaacagcgccgaacccaccctgtggcctgttctttctgccctgagttctcccatcacgttgagttcacatgtaacttggtgactcagcactgtagtggagaggcctgtttcctagcagagttgttggagtttgcagaagttatttttgctgtctatcatgaaaataccaagtcagcaagtgatataatcagtattgagtcatgcaaagagtatctgcttggagtagtaaaagttccaacaaaagagctgctgatcaagagatctgggatcacaggatggtatcctatcattttaccagaagacgggggcctacctcatggcctggagctcatgcagaagatcgtgggtggtctggagctttcgatttccttcacgcatcgtggagatagagaacgggtgttggaagctgctgagcatttgggctggagctttgagaacagcctgaaagattttgtcagaatggatgaaggggagccagccactgtcaccatctccaccccaaggctgtggctgcccatccattgtgtgctgcttgctggccacaaccacattcataagaatacatattgctaccttcgctacaagttctatgatcatgaagccttttggacccctctcaagaagcctaaggaatctgtaaacaaaaagcagattatggtcactttcaaggcatccaaaagagcagaagtcaccaggggcccatcactgctttggtacttcagggaggagaggctagagatccaagtgtggcgagcttatggcaatgacagtgtggagagaccccatcagacagacagctggattggctcagcctatgtggacctggccagacttggggagaggtcagcgaggacgctaactgtcagtggtgtgtatcctctgtttggacgaaatgcttccaacctctcaggagctgccttgcgagttcatgtggttctttcctctctttcctcacaccttgagcccactcatgagctggactccatggactgcagcagccacagtgagtctgagcagctccccagaaggaatgatgaggtccagctctctccaccagaagtcatctcctgccaccagaagtctcctgcctccacccaggtcccctgcagcagcaccacagctgaagtccgcctgacgcaggagggccctgctgatttggatggaacgtttgcagtcagcatcctagtagaaagagcaatgcacttgagcttgaaagggagccccttgacagagcggaaagtatcgatacccagttgttgtgtatcctttgcaacagccgatgagtcatctcctgtatacacccaagtggttgaaaacacagattcccccatctggaattttcaacagcagtcaaggctatcaaaagagctgcttctggacccacaacaaaccctggtcttcaaagtttggcataaaggagatgaggagagggtgattggctttgcctcggtggacctctccccacttctctctggcttccagtttgtctgtggctggtacaacatcacagacttcagtggagagtgccaggggcagataaaagttgctgtctcccctttggagagtttgatacacttcaaagaagaaaggcaagcaaggcgtggagtggagacctcaaaatcactgatcccaatatacagtcccttttccttccctgcctctgatacgtatgctgcattctccagccacatggcaaggcagaccctagaccaacttgctcatgcctcctcaaaggagcttgatttctcctctcctgggagaagtgataccacaagaagccaagcatcacgccatgaagagcatgtgcagaacattcgccggtttcatgaatccctgcatcttcagggagaggcacccttgccatgtgatgacaaactgaccacatcacctttgtcctcccaaacctccattctgacttctctcaggaagaatctgagtgagcttgatcagattcagaggtacttccgccagaagctcaccaagcctttcctacccctcagccctcagactcaaacggccatctcacagcaccaggagagctgtagggaccatcttgggccaggtgccagcagcctagaccctgggagccagtgtatcctggagaaatccagtaacctggtgttgcaagtcagctccttaatcacagatctgcagactatcaccagggattcgcaagcagctttgagttctcaccgagccaggagtagaagcaacaaggccaccaccctcccagatgctcaggacacagaagcactgcaagaacgatgcacaatgccagatgagccattggtaagagctccagataaaggcacagattccccatcaccccctcctctcgaagagacttcaaatggaggaagaatgctccatgagtccctgaggcatgcagtacccattacaaggatgcagagcagtgaagacactgaggcaggcccagcctacagtgatgaggactatgaagaagacatcattgagcccaggaccttaaatgagatcaccacggtgacagacaaaactagcccttggtctagtgtcatatcagacacaagtgaggtcatcagccctcagcctgacgaggtgcagagggaaggcccctcttgtccttctccagggcctttctgcagagaggagcttatggtcaaaagtagctttctctccagcccagaaagggctgtcaacccccacctgcctaggcagggttctcctagccaaagtcttgttgcttgtgagtgtgaggcctctaaggccagggttggtggcgagtctgcctcagccaaccctcagcccatcccatgcccaacactctcaggagctcaacagagcagcacgtttgttggatggagctcaccacagacagatcagaacaaggagcccaagtcagaggccccagctgagaatgaagctgccaccagtgagctcggtgactctgctgatagcttcaagaagttgccgctaaatctagcctcccagagcagaagggaaaaccataagggaccacccatcgactcctctgacatcaggcagaggcaggtgacaactggatcagagacgtccacaaagcagagcctcctgctcccagggcccattgtggtgcccaacttctttttgcctccccagcagttggaggcttccctgcggatgctttcactctcagcaactttgccaccagcagccacaacagatcaggacaagagcgaagccaccaggggagctctctcccaaaggccttgtcgccccagacctaactcgctccccctcaacctgcctgaggaagaaactctcaggattgcacggatattttcttctcagtactcccagaaagactga

SEQ ID NO: 1081 - DNA, 461 bp, Homo sapiens
gcataccaactcaccactcctgacaccatgaactactacggcaactactatggaggcctgggctacggctacggaggcttcgatgacctgggctatggctatggctgtggatgtggcagcttccgcagactgggctatggcggtggctacggaggctacggatacggctctggcttcggaggctatggataccgcagctgccgtccatcatgctatggaggatatggattctctggattttattgaaatccttccctgacaacctaacatgaggggacataagaagatcacccaaacctgactgcaataacaaacaaacgaggtcaccctggatcaagccaagatcaagagcagttagcatctaagaggtttaagaatacctatcattccataattctttgctttatgtctctggatgtgtcttacttgtacctttataactgtggggtttctctgttcct

SEQ ID NO: 1082 - DNA, 208 bp, Homo sapiens
atgtcctacaactgctgctgtggaaacttctcctcccattcctgtgagggctacctgtgctactcaggctactcccgtggtggctcctcgtaccccagcaacctggtctacagcactgaacctttgatctcccagcacctgccagctgggttcctctctctgcaagggctttcaggagacttgctgggaaacccctagctgccagatg

SEQ ID NO: 1083 - DNA, 737 bp, Homo sapiens
ctgtcttggaaacctacctagaacctccaccctctgacaccatggttaactcttgttgtggctctgtctgctctgaccagggctgtgatcaaggcctctgccaagagacctgctgccgccccagctgctgccagaccacctgttgctgccccagctgtgttgtatccagctgctgccgcccatcctgctctcagactacctgctgccagaccacttgctgtcgccccagctgctgccacccagtctgttgtcagaccacctgccgccccagctgtggtgtgtccagctgctgccgtccactctgttgtcagaccacctgccgccccagctgtggtgtgtccagctgctgccgtccactctgctgtcagaccacctgctgccgtgcaacttgctgccgccccagctgctgtggatcctcttgttgaacctcatattggactatcaaccatgagccagtcaccatcccatgatatgaaagtgtcatttatatcaacttgtccatgtgttaaatggccatcagctttattatcctgttattccactaagtaactggtgaaagggcatccatctacatttaataccactcatttttcccatggatctcttcccagcagcattcagacctcagatgcatgatgcagttagactaagcctctaagtttctgactgttatgcttgatttgaccttcaaaattacatattaactgttcttcaataaatattatcttaatatcagt

SEQ ID NO: 1084 - DNA, 775 bp, Homo sapiens
gaactccggctgcgttaccgacctgcgagctgacgggcccggaccatggggtgctgcccgggggactgcttcacctgctgcacccaggagcaaaactgctgtgaagagtgctgctgtcagccgggctgctgtggctgctgcggctcctgctgtggctgtgggggctctggctgcgggggctctggctgcgggggcagctgctgcggatcgtcttgctgtggatctggctgcggaggctgtggaggctgcggaggctgcgggggtggctgctgtggatccagttgctgtgggtccagttgctgcggctccgggtgctgtgggcctgtgtgctgccagcccacacctatatgcgacacaaaatgaagacctttccctccaccactgatgcagtcccaccgaaagcctccatctgctccagggggacagcccctcgtgtccagaaccttccatacccccaagacagtgtcttgtctttctgtgatttgtagaggagggcttgttctccaacaccttctctggtatttcaaggcaccgagaacaagagccatactctgatgaaacattaaaactcggtcacaactaagtgatcccaagctcaagggtgaatccccaatactttacttattcacatgaagttcaatgtcttgtactataagacatcctcttcttcaaggtgtctttgggactgatcctccgccctggctttctgcagctttgagatgcaaaaaaggtccatcttctttgtgagcctcttaataaatttgagcatgctggc

SEQ ID NO: 1085 - DNA, 4362 bp, Homo sapiens
agagcgaagctgaggagtccagcgctcgccgacaggggcctgggctgtcccgagccggaatccagatcttacataagatggaagtctctcacactagatactgaacattaaatagaaaatctatttagtaaaatctaagttgccatggaagaaataccagtaaaagttgctgtaagaattagacctctgctttgcaaagaagctcttcataatcatcaagtttgtgtgagagttattccaaacagccagcaagttatcattgggagagatagagtcttcacttttgattttgtttttggcaaaaattccactcaagatgaagtttataacacatgtataaagcccctagtgttgtcactcattgagggctataatgcaactgtttttgcctatggacaaactggatctgggaagacatacaccattggagggggccatattgcttcagttgtggagggccaaaagggtatcattcctcgagctattcaagaaatatttcaaagcatctctgaacatcctagcattgactttaatgtaaaagtatcttatatagaagtgtacaaggaagacctaagagatcttctagaattggagacatccatgaaggatcttcacatccgagaagatgaaaaaggaaacacagtgattgttggggccaaggaatgccatgtggagagtgcaggtgaagtgatgagtcttttggagatggggaatgcagccagacatacaggtaccactcaaatgaatgagcactccagcagatcacatgcaatttttacaatcagcatttgtcaagttcataaaaatatggaggcagctgaagatggatcatggtattcccctcggcatattgtctcaaagttccactttgtggatttggcaggatcagaaagagtaaccaaaacggggaatactggtgaacggttcaaagaatccattcaaatcaatagtggattgctggctttaggaaatgtaataagcgctcttggggacccacgcaggaagagttcacatattccatatagggatgctaaaattacccggcttctgaaagattctctgggaggcagtgctaagactgtcatgatcacatgtgtcagcccctcctcctcgaattttgatgagtccttaaattctctcaaatatgccaacagagcacggaacattagaaacaaacccactgtaaacttcagccccgagtcagaccgtatagatgaaatggaatttgagattaaattgcttcgagaagctttgcaaagccagcaggctggtgtcagccaaactacccagatcaatcgagaagggagtcctgatacaaataggattcattctcttgaggagcaagtagctcagcttcaaggagaatgtctgggttaccagtgttgtgtagaagaagcctttaccttcctggttgacctaaaagatactgtcagactaaacgaaaagcagcaacacaaactgcaggagtggtttaacatgatccaagaggtcaggaaggctgtcctcacctcatttcgaggaatcggaggcactgcaagtctggaagaaggaccacagcatgttacagttctccagctgaagagagagcttaagaaatgccagtgtgtgcttgctgctgatgaagtagtatttaatcagaaggaactggaggtgaaggaactgaagaatcaagtgcagatgatggtacaggaaaacaaagggcatgctgtatctttgaaagaagcgcaaaaagtgaatagactgcagaatgaaaaaataatagaacaacaacttcttgtggatcaactgagtgaagaactaacaaaacttaacctgtcagtgacttcttcagctaaagaaaattgtggagatgggccagatgccaggatccctgaaaggagaccatatactgtaccatttgatactcatttggggcattatatttatatcccatcaagacaagattccaggaaggtccacacaagtccgcctatgtactctctggatcgaatatttgctggatttcgaacacgaagtcagatgctgttgggtcacatagaagaacaagataaggtcctccactgccaattttctgataacagtgatgatgaagaatcagaaggccaagagaaatctggaactagatgtagaagtcgttcatggattcagaagccagactctgtttgttcccttgttgaattgagtgatactcaggatgaaacacaaaagtcagatttggagaatgaagatttaaagattgattgtctccaggagagtcaagaattgaatttgcaaaaattaaagaattcagaacgcatacttactgaagctaaacaaaaaatgagagaacttacaattaacatcaagatgaaggaagatctgattaaagaattaataaaaacaggtaatgatgccaagtctgtaagcaagcagtattctttgaaagtaacaaagctagagcatgatgcagaacaggcaaaagtcgaactgattgaaacacaaaagcagctacaggagctggaaaacaaagatctttctgatgttgcaatgaaggtaaaattacagaaagagtttcgtaaaaagatggatgctgcaaagctgagagttcaggtcttgcagaagaagcaacaagatagtaagaaactggcatcactgtcaatccaaaatgagaaacgtgctaatgagctagagcagagtgtagatcacatgaaatatcaaaagatacagctacaaagaaaactacgagaagaaaatgaaaaaaggaagcaactggatgcagtaattaagcgggaccagcaaaaaatcaaagccttaaacacagatagtttgaaaatatcaactcgcctgaacttactggaacaagagttgtctgaaaagaatgtgcagctccagaccagtacagctgaggagaaaacaaagatttcagaacaagttgaagtcctccagaaagaaaaggatcagctccagaaacgcagacacaatgtggatgaaaaacttaaaaatggtagagtgttatcacctgaagaagaacatgttcttttccaacttgaagaagggattgaagctttggaagctgcaattgaatacaggaatgaaagtatccagaatcgccagaagtcacttagagcatcattccataacctctctcgtggtgaagcaaatgtcttggaaaagctagcttgcctgagtcctgttgagattagaactattcttttcagatatttcaataaggtggtgaatttgcgagaagctgaacggaaacaacagttatataatgaagaaatgaaaatgaaagttctggaacgggataatatggttcgtgaattagaatctgcactggaccatctaaaattgcagtgtgaccggagactgaccctccagcaaaaggaacacgaacaaaagatgcagttgctattacatcatttcaaagaacaagatggagaaggcattatggaaactttcaaaacatatgaagataaaatccagcagttggaaaaagatctttatttctataagaaaaccagccgggatcataagaagaaacttaaggaactggtaggggaagcaattcggcggcaactagcaccatcagagtatcaagaggctggagatggagtcctgaagccagaaggaggaggcatgctttcagaagaattaaaatgggcatccagacctgaaagtatgaaattaagtggaagagaaagagaaatggacagttcagcaagcagcttaagaacacagccaaatcctcaaaagctctgggaagatatcccagaattacctccaattcatagttctttagcaccccccagtgggcatatgttaggtaatgagaataaaacagaaacagatgataatcagtttacaaaatctcacagtcgactgtcatcccaaattcaggttgtgggaaatgtgggacgacttcatggtgtcacacctgtaaaactgtgtcgaaaagaattacgtcaaatttccgccttggaactatcattgcgacgttccagtcttggagttggcattggatcaatggctgctgattccatcgaagtatctaggaaaccaagggacttaaaaacttagacattgaataatagaacttttagtagatatgtaaaaagattcctttttctaacctgttaaaaactaaagctcaagttcactacctctttcctcagaataaaggaagaaggggaggaaggaatccctaattcttttatatgctatagatgtgtacatcttctatatatatttggggagttttagtttatattcccatagtaatcaaacatgttttccaatacttgataacatttaaatatttataaatacgcttaaatgtttttccaggcatatttgaagattaaaactagtaatagactaaaa

SEQ ID NO: 1086 - DNA, 2064 bp, Homo sapiens
gtcccggctccagaacgccgcggcactggggcgggaggggcccgccacgtccgccatcttgaaacaaccgccactcggggcgtcgcgcctgggccgccacgcctcggcctgcaggctcggtccccattggccgcaccacgcagaggcccgcccccgcctgcgcggccggcccctgcggggcgagagggtgggggcgaaggggaagctacgtcccggaggtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatc

SEQ ID NO: 1087 - DNA, 492 bp, Homo sapiens
gcaaataaagaacgcaggagccttgtctcctactgggctgtcagtgaggaaaaggaggaaagacaggttagctggggatgatgacggatctgaagcaaagccattcagtgaggctgaatgatggacccttcatgccagtgctgggatttggcacttatgctcctgatcatactcccaaaagccaggctgccgaggccaccaaagtggctattgacgtaggcttccgccatattgattcagcatacttataccaaaatgaggaggaggttggacaggccatttgggagaagatcgctgatggtaccgtcaagagagaggaaatattctacaccatcaagctttgggctactttctttcgggcagaattggttcacccggccctagaaaggtcactgaagaaacttggaccggactatgtagatctcttcattattcatgtaccatttgctatgaagggttcttcctgagagaggcagatttgagtgaggtgca

SEQ ID NO: 1088 - DNA, 1438 bp, Homo sapiens
agtgcgcgtgcgcagcggttgcctgggcgaccggggaagcgttgggctgtaaagactagggcgccagcggctggcgaagaaggaaagagggtactctctggctgggctggggccgtagcgacgtccgccgcgaacctgggccccccaaagctgcggggcgttcggtgtcgccgaagtaaacatgcaccctgagccctcggagcctgcgacaggtggtgcagcagagctggattgcgcgcaggagcccggcgtggaggagtctgcgggtgaccacgggagcgcaggccgagggggctgcaaggaagaaattaatgatcctaaggaaatatgtgtgggttcttctgacacatcctaccacagccagcagaaacagagtggtgataatgggtcaggtggtcacttcgcacacccaagagaagacagggaagatcggggccccagaatgactaaaagttccctgcaaaaactctgcaagcagcacaagctttatattaccccagcattgaatgatacgctgtatttacactttaaaggttttgatcgcattgagaacctggaagagtacacagggctgcgctgtctctggctgcagagcaatggaatacagaaaatcgaaaacctggaggcccaaactgagttgcgttgcctcttcttgcaaatgaacttgctccgtaaaattgagaacctggaacctctgcagaaactggatgctcttaacctcagcaacaattacatcaagaccattgaaaacctctcctgcctcccagtcctgaacacattgcagatggcccacaatcacctggagaccgtggaggacattcagcatctacaagagtgtttgaggctttgtgtccttgacctttcgcacaacaagctgagtgacccggagatcctgagcattctggaaagcatgcccgatttgcgtgtactgaatttgatgggaaacccggttatcagacagattcctaattacagaaggacagtcactgtacgactaaagcacttaacatacctggatgatagaccagtgtttccaaaggacagagcttgtgcggaggcctgggctaggggagggtacgcagctgaaaaggaggagagacagcagtgggagagcagggagcggaagaagatcacagacagcattgaagccttggccatgatcaagcagcgggcagaggagaggaaaagacagagagagagtcaagagagaggggagatgacatcttcagatgatggtgagaatgtgcccgccagtgcggaaggcaaggaggagcctcccggggacagagaaacaaggcagaagatggagctatttgttaaggaaagctttgaggccaaggacgagctctgcccggaaaagccaagtggagaggagccgcctgtggaggctaaaagagaggatggagaccctgctactgtcaccgcctgtgaaggttaa

SEQ ID NO: 1089 - DNA, 3004 bp, Homo sapiens
attgctttccaggggtcactctggcttcgactccgtcgctctcaattcgtcaccaggaggaagacggagctggctgcccagcccaaaggcccatgaggggatgcagttatgggctctgtcgccgtggaacttgtttgcttcattcttatgtacctacctttgcaccttgtaatcatcctttatgcctcagattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagggctgtggcagaaattctcaggagcagcatgccttgaagcactatctgacgccaagatctgaacctcactgtctggttcttagtttggacaactggagtgtatggtgttacgtatgtgataatgaggtccagtattgtagttcaaaccagttgggtcaagtggttgattatgtcagaaaacaagccagcattacaactccaaagccagcagagaaagataatggaaatattgaacttgaaaataaaaaattagaaaaagagagtaagaatgaacaagagagagaaaagaaggaaaacatggctaaagagaatcctcccatgaattctccttgccaaataaccgtgaaaggactcagtaatttgggaaacacatgtttcttcaatgcagttatgcagaacttgtcacaaacaccagtgcttagagaactactaaaagaagtgaaaatgtctggaacaattgtaaaaattgaaccacctgatttggcattaacagaaccattagaaataaaccttgagcctccaggccctcttactttagccatgagccagtttcttaatgagatgcaagagaccaaaaagggggttgtgacaccgaaagaactcttttctcaggtctgtaaaaaagcagtgcggtttaaaggctatcagcagcaagacagccaggagctgcttcgctacttattggatgggatgagagcagaagaacaccaaagagtgagtaaaggaatacttaaagcatttggtaattctactgaaaagttggatgaagaactaaaaaataaagttaaagattatgagaagaaaaaatcaatgccaagttttgttgaccgcatctttggtggtgaactaactagtatgatcatgtgtgatcaatgcagaactgtctccttggttcatgaatctttccttgatttgtccctcccagttttagatgatcagagtggtaagaaaagtgtaaatgataaaaatctgaaaaagacagtggaggatgaagatcaagatagtgaggaagaaaaagataacgacagttacataaaagagagaagtgatattccttctggaacaagtaagcacttacagaaaaaagcaaagaaacaagccaaaaagcaagccaagaaccaacgaagacaacaaaaaattcaaggaaaagttcttcatttaaatgatatttgtactattgaccatcctgaagacagtgaatatgaagctgaaatgtcacttcaaggagaagtaaatattaaatccaaccatatttcacaagagggtgttatgcataaagaatattgtgtcaaccagaaagatttgaatggccaagcaaaaatgatcgaaagtgtaactgacaatcaaaaatccacagaggaagtagatatgaaaaatatcaacatggataatgatctggaggttttaacatcttctcccactaggaatttaaatggtgcctacctaacggaagggagcaatggagaagtggacatttccaatggtttcaaaaacctaaatttgaatgctgctcttcatcctgatgaaataaatatagagattctgaatgatagtcatactcctggaacaaaggtgtatgaggttgtaaatgaagatccagaaactgctttctgtactcttgcaaacagggaagttttcaatactgatgagtgttcaatccaacattgtttatatcagttcacccgtaatgagaaacttcgagatgcgaataaactgctttgtgaagtatgcacacggagacagtgtaatggaccaaaggcaaatataaaaggtgaaaggaagcatgtttacaccaatgccaaaaagcagatgctaatttctcttgctcctcctgttcttactcttcatttaaagagatttcagcaggctggttttaacctacgcaaagttaacaaacacataaagtttccggaaatcttagatttggctcctttttgcacccttaaatgtaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaaa

SEQ ID NO: 1090 - DNA, 7546 bp, Homo sapiens
cgggcgccggggagagcgggcggccgggcggcaggcgggcgagcagcgatcgggcggccgagcgagcgagcaacgccggcgcagcgcggtgaccccagccccagccggcgcggagcaggagccggagccgagcggatctcggcgccctcgctgcgctcctcccggcccgagcctgccctacccggcggtggcggcggcgcgtcctccagcggcggcagcggcgctcgcagcgcccggactcacggcagctgtgttctgatttcgtactactgctggggctgccacctcctcctccagacgctctcagcagacttgagtcctggtccttctgcagaggcctgagcaggaggaagaggaggaggcccgttggcgtcggaccaatgctgcaaggggtgtgaggagaggagccgctgtttttcactgagctgccataccccgaaagcaggatggagctggagtgaggtggaggggccgcaagctgctgaccggcgtgtggaacactggtggtttgcagatcactgaggctggacaacgttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccacgggccttccagcggcccttcgagcagagcctgatgggctgtttgacggtggtcagtcgggtggcagcccagcaaggctttgacctggacctcggctacagactgctggctgtgtgtgctgcaaaccgagacaagttcaccccgaagtctgccgccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccaaccagcctcccggctccctttccgtggtcaccacggtttggggagtaaccaacacatcccagagccaggtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgctgacttcactcagcccgcggcagccgctgcagcagcggcagtggcagcagcagcagccacagctacagccacagccacggccactgtggcagccctgcaggagacacagaacaaggatataaaccagtatggaccgatgggtcccacccaggcgtataacagccaattcatgaaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggacgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcagggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccagatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagcccacccaccaccacccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagctctcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaacaaa

SEQ ID NO: 1091 - DNA, 2377 bp, Homo sapiens
gacacccaggcagtccctgacgtgtcggggaggagccgggcgcggaggtacgctgagtggagctcggggctgcgtaggggagctgagccgagcggctgggcgggcctggccgggccggcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaaggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctccgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaaggattgacgttgcttta

SEQ ID NO: 1092 - DNA, 3284 bp, Homo sapiens
cattcggggctggaactcgaacgctgacgttggctcctgagccgggcgctgcctcgcgcctgattggcgggtcctcggggccgccctccccagcgcaccacccctgggttccctcccgggtccgcagtggaaacactgccctctcccttcttgacccctagcccttccttccctccctccttccctcctgtcgccgtctcttctggcgccgctgctcccggaggagctcccggcacggcgatgggttctcgggcctccacgttactgcgggacgaagagctcgaggagatcaagaaggagaccggcttttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcactttgcttttcgactatatgatttggataaagatgaaaagatctcccgtgatgagctgttacaggtgctacgcatgatggtcggagtaaatatctcagatgagcagctgggcagcatcgcagacaggaccattcaggaggctgatcaggatggggacagtgccatatctttcacagaatttgttaaggttttggagaaggtggatgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtctgccagcatgcttcttcatcctttttatatgttctttgcttcctacttccctgtcttccaacatactgttcacttactctggcagtctttctgcttttcattaagcctcaaaatctcctctgttctacttggcaccacaagctatgtcctatatatgtatttctgacttggcaggatagttcaggggtctggcagtttttatttaccttcattattaaatgggcctctgggatgttgcctcttcaggagctttttggtaatcaatacttctctcagaagtatgagaccatcctctgcactctgctctgtcatcaaaggctgctgggtggagataccctttttgaaaggtggccttggtgagaggtatggagccaagtcttctaggttgcttgcccacatcactctatctctggcctctgattctcaactttgtacctgtgtggctcctcttgttagtgcaatgttgactgttgaaaaagcagcagtatgcttacaggtttgcttagtttggggacaccgttaccaccagaatggctgctctgacaatatgcctagggactttctcatggcttttatttaataaggaggctgggcaccctataaagcctcatgcattcacacctttgcagcatggtttatgcctcagtgttatgtgcactggaatgttttccacttcacatttccaagtagaaatattagtgttacggaagtgcctaatatcccagtccaaatttttttttttttttttttttttttttgagacagagtcttgctctgtcacccaggctggagtgcagtggtgcgatcgctcactgcaacctcagcctcctggatttaagtgattctcctgcctcagcctcccaagtagctgggattacaggtgtgcaccaccatgcccggctaattttttgtatttttagtggagacagggtttcaccatgttggccaggctggtctcgaactcctgacctcgtgatccgcctgcctcagcctcccaaagtgctgggattacaggtgtgagccaccacgcctggccccagtccaaaatatttaaagattgtttccttagtgtcttgaagttttgcacaaaattcttttttttgagatggagtctcactctgtcacccaggctggagtgcagtggcgtgatcttggctcactgcaacctctgcctcctgggttcaagcaattctcccacctcagcctcccaagtagctgggattacagacgtgtgccaccatacctgggtaatttttgcatttttagtggagagggagtttcaccatgttggccaggttggtcttgaactcctgacctcaggtgatcctcctgcctcggcctcccaaagtgctgggattacaggcatgagccaccgtgctcagccgcaaaattctttatgaattttacacttggcaaatgttaatgacggaagccatagtctgctcctaatacatgtccaaagcattgactgttgtgtcattagctgcctggttacattagctccctggcttcttgtttagaccactgctaatcccttaaaaacaagaggtctggcactagtagcacaacctaaggtggcattacagatctttgagcgagccacagcaacttttctgccaagtcagcttagtttagacttcagtgaatcaggctattgctatcctaatgtatgtctctatgagtgtatttagccacacatctgcccttggttgactttctgactcattgcttgcttgcttgtttccttgctttggaaaactattgaagattgctaaaaaataccactgcaaagtgatggaaaagggtggagaacaggggagtagccaggctggatggctcaaatataaatgaatgaggaattctttatgaagtatcagtcagattttatgattaagtgatgtaatataggaattatgtaaaagggaagaatgtctgatactgatctattagagaggtactttagaggcttcttgattggcataaagttcctaaggttatagattttccccccttttggctgtatagcaaagtgttttaatccacggttgtgccttattgttccattaaaatt

SEQ ID NO: 1093 - DNA, 876 bp, Homo sapiens
accacccagtccagcacccaccatggctgacgcctgctgcaccaggacgtatgtgattgctgcatccaccatgtctgtctgctccagtgacgtgggccatgtcagccgagtctcctcccccagcacctgcactggctcctcctggcaggtggacaattgccaggaaagctgctgcgagccccgctcctgtgcctccagctgctgtacccctagctgctgtgccccagccccctgcctggccctggtctgtgccccagtgagctgtgagcccagcccctgccaatcaggctgcaccgactcctgcacaccttcatgctgccagcagtctagctgccagccggcttgctgcacctcctccccctgccaacaggcctgctgtgtgcctgtgtgctgcaagtccaactgctgcaagcccgtgtgctgcgtgtccatctgctctggagcttcctccccatgctgccagcagtctagctgccagtcagcttgctgcaccttctccccatgccaacaggcctgctgtgtgcccatctgctgcaagcccatctgctgtgtgcctgtctgctctggggcttcctctctgtgctgccagaagtctagctgccagccggcttgctgcaccacctcctgctgcagaccctcctcctccgtgtccctcctctgccgccctgtgtgccggcctgcctgctgtgtgcctgtcccctcctgttgtgtccctgcctcctcctgccagcccagctgctgccacccggcctcctgcctgtccttcctctgccgccccgcgtgctcccgcctggcctgctgaggcctctgctcaggccaggagtccagctgctgatgggcacgtcccccagggccagccggctccggtcctgtcct

SEQ ID NO: 1094 - DNA, 254 bp, Homo sapiens
cctgaaccatccatttctgacaccatgatttactacagcaactattatggtggctatgggtatggtgggcttggctgtggctatggctgtggttatcgtggctatggatgtggttatggtggctatggaggctatggaaatggctactactgcccatcttgctatggaagatattggtcatatggtttctactgaacaattctagagctcaccagatttgtctgcttgtgaaacctggattctcatgctgctct

SEQ ID NO: 1095 - DNA, 1234 bp, Homo sapiens
acactcacttacacctcccccagctcacctcctccccaccccagcatggccgcgtccaccatgtctgtctgctccagcgcttactccgactcctggcaggtggacgactgcccagagagctgctgtgagcccccctgcagcgcccccagctgctgcgccccggccccctccctgagcctggtctgcaccccagtgagctgtgtgtccagcccctgctgccaggcggcctgtgagcccagcgcctgccaatcaggctgcaccagctcctgcacgccgtcatgctgccagcagtctagctgccagccggcttgctgcacctcctccccctgccagcaggcctgctgtgtgcctgtctgctgcaagactgtctgctgcaagcctgtgtgctgtgtgcctgtctgctgtggggctgcttcttcgtgctgccggcagtctagctgccagccagcttgctgtgcctcttcctcctgccagccggcctgctgtgtgcccgtctgctgcaagcctgtgtgctgtgtgtccacctgctctgaggattcctcttcatgctgccagcagtctagctgccagccagcttgctgcacctcctcctcctaccagcaggcctgctgcgtgcctgtctgctgcaagactgtctactgcaagcccatctgctgtgtgcctgtctgctctagggcttcctcttcacgctgccagcagcctagctgccagccagcttgctgcaccacctcctgctgcagaccctcctcctctgtgtccctcctctgccaccccgtgtgcaggtccacctgctgtgtgcccgtctcctcctgctgtgcccccacctcctcctgccagtccagctgctgccgcccggcctcctgcgtgtccctcctctgccgccccgcaagctcccgcctggcctgctacagcctctgctcaggcaagaagtccagctgctgagtgctcaatccttgtctcctgctgactgtgtctttgctgccaagcaggattctccagtctcaggagcccctggagtcctcagaatccaccagctccatcagtagccacagagctgctgcctgaaggggattttgagcgcgtcacactttcctccccactgtctgggaagagacaacccacaaatccctcagcaggtggactgtggctttctggagcccccttctccaaatgtgttgcttatacccaatgtgacaaagaagaactgctctaatcaataaattcttgagtcagg

SEQ ID NO: 1096 - DNA, 2479 bp, Homo sapiens
gtcgcacatgcgcacagagcccgggcggctacggaagcggtgagactgtctctcggctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggaggtagtgaacaccttgtatgaggatatccagtacatgcaggtacctgtggctgactcccctaactcacgtctctgtgacttctttgaccctattgctgaccatatccacagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacactgtgcacatggtcagttccccagtgggaatgatccctgacatctatgagaaggaagtccgtttgatgattccactgtgagccatcccacgagcccctgcattggagtcagaggtacagatctattgttgatcttacaccaagatccaaacttgaacattctacttttgttgatacagaaaaaaacagatgatgccttttatgagcacaaaaaagagttgctgtagcttttaactttataatccattttttttaagattaaactaattgtgagatggtgaagataaattttctgccctgtgagtgacactggccaggggataggttgaggcagatggtgcccagaagaaagagggcagcacccattgcacatggcaggcctggaatcctgcagccctccccaaaaacagattgacccaggaatgaatctgctacaattccacctcattctttcacacccagagccagagccttaagcatcatggtacctcttgcgcttcttacagtgagtgccaatctactagataaatggccttcaggcagtgctccaggaatcctggggggtcccaggccacctctgcttccaccttcactataagtggcccagttctggttttctagattgtacttatgcataagatagtttttaaagaaagcattccactgtgtaaatttttttttgtctttttttgaaactgtcctgctctgtcacccatcctagagtgcagtagtgtgatcatggctcactgtagccacaacctctcaggctcaagtgatcctcttaccttagcctcctgcgtggctgggactacagatgtttgccaccatgcccgcctcattttttttctttttttatagagatgagattttactatgtcgcccagactggtctcaaactcctggcctcaagcaatcctcacgcctcagcctcccaaagtgttgatgagccactgtaccccgataccactgtataaaaaatttaaaaaaaattgtgagtgctattgtacatggcaaagtttcaaagagctcttggccatccctcaccaaactttggcaaaagatggtgttagtccccttctccagggcacatgagaaaaacaggcctaacatcaggtctcagcggttcctctcacaggccttggcttggaaggctggagcttcggaccaaggcccagccctgtcacctcctcttcatgtgatgtggacccctgggagcatcagtgtcctcatctgtccaatgacagcccttttctcacagagttattgtgaagattcaacaatttcttggcatagtgcctggcacatggtgtgtgcttagcgcaaatggcagctctcatcatgaatgatagactctttcaccctgctggtcccaggtcggcacacacatccccataatggcatttctcctttctgtgcacagcactttattgttacaaagtactcttccaaaaagttaccctgtgtgtaaaaaaaaaaaaaaaaaaaaa

SEQ ID NO: 1097 - DNA, 199 bp, Homo sapiens
caactgagcctacctttcttgaaaccatgagctttgataacaactaccatggtggccagggctatgccaaaggaggcctgggctgcagctatggctgtggtcttagcggctatggctatgcctgctactgcccatggtgttatgaaagatcttggttttctggctgcttctgagaaattagagattgctgatctgttta

SEQ ID NO: 1098 - DNA, 440 bp, Homo sapiens
acaacagctaaccacttctgacaacatgagctactccggcagctactatggaggcctaggctacggctgtggaggattcggtggcctgggctatggctatagctgtggatgtggcagcttccgcagactgggctatggctgtggctatggaggctacagatacagctgctgccacccatcatgctatgggggatactggtcttctggattctattgaataaatacttgaaatatagtcttctgtgagattcccaattcttccaagaaactttattccataaccatatggaattccatattccataacaaaacagctgcttggatcacctgccttttgacaatagtgtgaagaaaacttgatcaactagatattggcatttgattagtgatgttctccagatattcacttttttattggctggagagccattatactctaa

SEQ ID NO: 1099 - DNA, 311 bp, Homo sapiens
caaggacaacctccacaaccatcacgatgtgcggcagctactacggaaactactacggcgaccatggctatgggtgctgtggatacgaaggcctaggctatggctatggaagcctgcgctgtggctatagctcctgctgtggctatggtcatggctacggctcccgcttcttctgtggctgtggctatggatgcggctctggctactactattgaggacaccgtgggagactcatcctctatcctgtgacatcgggattcaccaattctgaaccccgtatgctctgagctcggggctggatgaagattatc

SEQ ID NO: 1100 - DNA, 5586 bp, Homo sapiens
aggttcggctgcgcgagcggagggaggcggttccctcttatgcttttcatctccatccccagccccacccacagccagggggcttgggttctgagctgatggggtacccccctctgcagagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgggtttgaagggtgttccatggtgcctaccatctaccctctggaaacactgcataatgccctttccctacgtcaagtgagtgaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggtacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaatggtggtgatgga

SEQ ID NO: 1101 - DNA, 2311 bp, Homo sapiens
gatgtcacgtccggcggcggcggcagcggcagcggcagcggcgctgagttttgtctcccgggccgtctgggcgcgcgcgggtgtcccagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacaatcattcctggacccccgagggcctctgagtttgagacgctggctgagatcaaatgataagaattccaatttttgttttcctaagtctttcatctgctaatctacccaacatgaaccacgggccacatgaagggccagacacattcttaagcggctcacagcctagaggtgcacatctgtgattacaatgtgcaaggtaaaactggatcaacagtttccaaggactggcatgtaataaaatatcctcaaaacaacaagcaagttgggcgtgacttagactttcactgcccatgtagaaggcactgtacattcttgcagcatctcagttggccagcaagaggtgagtcagaaaaaaaccattcagcagccacatggaagtggggctcactgggcacaaggcaaaactgtgaagaagataaagtgtctgtggttctgcattgactctattccctggagtcctcccctctcgagttcctagaattatgttatcactcttgctctatctcattcctatcaagacctgttttagaaatgggtgccacagactcagttacattcaaatgtaaacccattcattcatttagcaagttacttattagtgccagtgctgtgtcaggttctacattaggtaccagagtacagtgatgagcaaaaccagtccctgcccttctggaacagagaagactggaagaggatgggggtagccattaatcaaacagtcacagaaatgagtgcaaaatgtagctggagtaagggcttccatggtgaggcacttggtgcagggatctctggatctgaccaaatcaggaggtcaggaaaggcttccaggaggaagtgacactgtgcccagagctcagggatggaagaaggatgctccttctgggcagagagtaaggagagaagattggtgggaaggagggcaggggccagatgccgtgggtgtgatttggatctgtgtccctgccaatcacatgttgaattgtagtccccagtgttggaggtggagcctggtgggacatgattggatcatgggggtagtttttcatgaacggtttagtaccaaccacttggtgctgttctagtgagttgagtgcattctcgcgagatctggttgtttaaaagtgtgtagcacccttccctcttgctcctgctcctccaatgtgagactccttgctttccctctgttttccaccatgattggaagcttcctgaggcctcaccagaggcagatgccagcatcatgcttcctgtgcagcctgcagaactgtgagccaattaaacctcttttcgttat

SEQ ID NO: 1102 - DNA, 1260 bp, Homo sapiens
tttccttcccaggtgtcgccgcctgctttctgcagccgctgcctgggaggggttccgaggttctgggcagccacagccccggaggccttacaggagcgacctggcaattcccgccgccggccgccagaggaagctgctttgctgctgtcgttgcccagcaactcgtagcccggaagcagtaccccgtctcgctcggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctatgaa

SEQ ID NO: 1103 - DNA, 3357 bp, Homo sapiens
gcggccgccgtagttgaatctcctcggcgccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcagctccttggcaagaaaggaaggtgccagcagccctgtgaatgggaaggacttggattacgtttccacctccaagacccagctggtcccatcctccaaagatggggatgtcaaagacatgctttcgcgggaccgggaaacttccagcattgagccccttccctcagactccccgaaggaggaattacgcccaattaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatagaacctcatcgccagtaccttaaaggacaagaccagcaactcccacctactgtagtggagctgctcaaccacctgcccagagctgcagccccctctactccaatgctgggacccagcacagagaacacatttggcctgcatgttgggaggagcatcctccaaggacaaccttgctcatctccacagagcactttgggttttaattcactgtcttatatgcagggacaggataaaataactttctagtttggactttcagtgctcatctgagaactttgtcttatttcctgtctgaaaggacatattctctatgtatgtgtgaggtcagaactgagtctcaagtaggaaggcagaaaagtagctcagccaggctcctcctggcaggcctttgtcacactggtcagcccctttcctggatagacatcctagggtgggggtggtgagctcggtctgaggagctctgcttctcacagctccctcagaccctaagttctctcaagacatcttttctgtgtttctgagccagtgaagaagacaggaggaggccctccttcatttggcaaccaggggaggataaggtctagccacagagaccagaaagggatgaggcagagctggctccatgta

SEQ ID NO: 1104 - DNA, 3771 bp, Homo sapiens
gattgggccgctgtcaggtgtcgctgcctgcaggttcggctgcgcgagcggagggaggcgggactcaagagtagccttcctcgaggacctgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaaggtgacaggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtactcccgaggcgtgctctccccaggtcgccacgttcgaacgcgtctctatttcaccagtgagagccatgtccactccctgctcagtgtcttccgttatggaggacttcttgatgagacccaggatgcagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgagctcttgtttgtcccggccgtaaaacgattttctgtgtcgtttgcaaagcatccgactaacgggtttgaagggtgttccatggtgcctaccatctaccctctggaaacactgcataatgccctttccctacgtcaagtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattag

SEQ ID NO: 1105 - DNA, 308 bp, Homo sapiens
cctcagaagcatcttcttgaaacccatctcaattctctcctcttgacaacatgtgttgcaactactacggcaactcctgtggctatggctccggctgtggctgtggctatggctctggctctggctgtggctgtggctatggaactggctatggctgtgggtatggctgtgggtttggctcccattatggctgtggttatggaactggctatggctgtggatatggctctggctctggctactgtggctaccggccattttgctttagaagatgctattcttcctgctaaaacatcactgtcggagga

SEQ ID NO: 1106 - DNA, 1941 bp, Homo sapiens
cttctccctggtcaaccgctctgcaaacaaccatcaatctgatcccacaggcctgagaaagtctgctctccagtacctgctgctgatctgtttcagccgacaagaggcaccatgaaattggaattcacggagaaaaactacaatagcttcgtgctgcagaacctgaacagacagaggaaacgcaaagagtactgggacatggccctgagtgtggacaaccacgtcttctttgcacatcgcaatgtgctggctgctgtctccccactggtgaggagcctcatctccagcaatgacatgaagaccgctgatgagcttttcatcaccattgacaccagttacctgagcccggtcacagtggaccagcttctggactacttctatagcggcaaggtggtgatctccgagcaaaatgtggaggagctgcttcgtggggctcagtatttcaacacaccacgccttcgagttcactgtaacgacttccttattaagtccatctgccgtgccaactgcttgcgctacctcttcttggctgagctgtttgagctcaaagaggtatcagacgtagcttactctggcattcgggacaacttccactactgggccagtcctgagggctccatgcacttcatgcgctgtccacctgttatctttggccgcctgctccgtgatgaaaaccttcacgtgctcaatgaagaccaggcgctcagcgcactcatcaattgggtgtacttccggaaggaggatcgggagaagtatttcaagaagttcttcaattacatcaatctcaatgctgtctccaataagacgctggtgtttgccagcaacaagctggtgggcatggagaacacctcatcccatacaaccctgattgagagtgtcctgatggaccgcaagcaggagcggccatgcagcctgctggtctaccagcggaaaggggccctgcttgattccgtggtcatcctcggtggccagaaggcccacggccagttcaatgatggagtgtttgcttatatcatccaggagaacctgtggatgaagctctcagacatgccctatcgggcagcagcacttagtgccacctctgctggtcgctacatctacatctctggtggcaccactgagcagatttcagggctgaagacagcctggcggtatgacatggatgacaactcctggaccaagttgcctgacctgcccatcgggcttgtcttccacaccatggtgacctgtggggggacagtgtactcagtgggcgggagcattgccccaaggcggtatgtctccaacatctatcgctatgatgagcggaaggaagtctggtgcctggcaggaaagatgagcatccccatggatggcaccgccgtgatcactaaaggagacaggcatctgtacattgtcactggacggtgcttggtgaaaggttatatctcccgggtcggggtagtggactgctttgacaccagcactggggacgtggtccagtgtatcaccttccccattgagttcaaccatcggcccctgctctctttccaacaggacaacatcctctgcgtgcacagccaccggcagagtgtggaaatcaatctgcagaaggtgaaggcaagcaagacgaccacctcagtgcctgtcttgcccaacagctgccccttggatgtgtcccatgctatatgctccattggagacagcaaggtgtttgtatgtgggggtgtcaccactgccagcgatgtccagacaaaggactacaccatcaatccaaatgccttcttgctggaccaaaagacaggcaagtggaagaccctggctcctccaccagaggcactggactgtcctgcctgctgtctagccaagctaccttgcaagattcttcaaaggatttaaacattttaagtgggagaataagtaaatgcattattattcacgatttaatgagagaaagagagg

SEQ ID NO: 1107 - DNA, 2332 bp, Homo sapiens
ggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaagggcttcttccctgtaccccaaggggcggcctgcctggcccctggataaacgctgcttgtgtttgtgcggccgacatctcgccaggtcacgagcatgatttccgagttaagcacctgtccgaggccttgaacgacaagcacgggccgctggccgggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttg

SEQ ID NO: 1108 - DNA, 378 bp, Homo sapiens
atggccggagctggaccgaccatgctgctacgagaagagaatggctgttgcagtcggcgtcagagcagctccagtgctggggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctga

SEQ ID NO: 1109 - DNA, 1141 bp, Homo sapiens
gcggccgcggagccccacccgctcctactccagtcctctcacgcccactgacttaccctgcgcacgcgcgctgaggctccgtggggccgccgcgggccccgccccgaggtgggagggcctgacgcatccacagctggccaatcggcggatggcctcgcgcgcccgccccctccccctgcccccggcgccgggctccacgtgccagtgtttgtgtacgtgcggccgtggcggggctggacagggtccgggtcgttgaggattaggctgctcgggcgtaaccggagctggggcgcggctgccaagggccggcccggaagtcccagcggtctttaaattctcccgtgctagggccagcctgcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggatgttttaggagaagctccactacacaaggcagcaaaagttggaagcctggagtgcctaagcctgcttgtagccagtgatgcccaaattgatttatgtaataagaacgggcaaacagctgaagatctcgcttggtcatgtggatttccagactgtgccaagtttcttacaacaattaaatgtatgcagacaataaaagcaagtgaacaccctgacaggaatgattgtgttgccgtgctcagacagaaacggagtctcggaagtgtagaaaataccagtgggaaaaggaagtgctgatgtcacgtgggttatgaagaagtctgaagaacgccttcatttcatgcaaatctataagctcctgcttttggctttaccatatgttgtgtctaatctccttctgagaaggacgaaaaactttcttccaagtgaagatccatttaagaacacatgtatttacatgcctataatatgctggttgtgtatgctttgtcttttaagttattaaaggaacgtctaaaaaa

SEQ ID NO: 1110 - DNA, 9766 bp, Homo sapiens
ggctgaaggcgatccggagtggggccccagcaattcggattgagccttctccctccacccgcttccgtcggccgggcccctcccgcccggccccgcgggcctccccacccggccccggcgctccccaccgccccccctgcgcccgcccctcccccttcgctttccttctccccccgcctcggctccgacatgaggggccggcggggcaggccgcccaagcagcccgcggctcccgctgcggagcgctgcgccccggccccgccgccaccgccgccgccgcccacgtccggacccatcggggggctccgctcgcggcaccgcggcagcagccggggcaggtgggccgccgcccaggctgaggtggcgcccaagacgcggctgagctcgcccagggggggcagcagtagccggaggaagccgccgccgccgccgccggccccccccagcaccagcgccccgggccggggggggcgaggaggcgggggcggcaggacggggggcgggggcggcggcggccacctggcccggaccaccgcggcccggagggccgtcaacaaagtggtgtacgatgaccacgagagcgaggaggaggaggaagaggaggacatggtctccgaggaggaggaggaggaggacggcgacgccgaggagacccaggattctgaggacgacgaggaggatgagatggaagaggacgacgatgactccgattatccggaggagatggaagacgacgacgacgacgccagttactgcacggaaagcagcttcaggagccatagtacctacagcagcactccaggtaggcgaaaaccaagagtacatcggcctcgttctcctatattggaagaaaaagacatcccgccccttgaatttcccaagtcctctgaggatttaatggtgcctaatgagcatataatgaatgtcattgccatttacgaggtactgcggaactttggcactgttttgagattatctccttttcgctttgaggacttttgtgcagctctggtgagccaagagcagtgcacactcatggcagagatgcatgttgtgcttttgaaagcagttctgcgtgaagaagacacttccaatactacctttggacctgctgatctgaaagatagcgttaattccacactgtatttcatagatgggatgacgtggccagaggtgctgcgggtgtactgtgagagtgataaggagtaccatcacgttcttccttaccaagaggcagaggactacccatatggaccagtagagaacaagatcaaagttctacagtttctagtcgatcagtttcttacaacaaatattgctcgagaggaattgatgtctgaaggggtgatacagtatgatgaccattgtagggtttgtcacaaacttggggatttgctttgctgtgagacatgttcagcagtataccatttggaatgtgtgaagccacctcttgaggaggtgccagaggacgagtggcagtgtgaagtctgtgtagcacacaaggtgcctggtgtgactgactgtgttgctgaaatccaaaaaaataaaccatatattcgacatgaacctattggatatgatagaagtcggaggaaatactggttcttgaaccgaagactcataatagaagaagatacagaaaatgaaaatgaaaagaaaatttggtattacagcacaaaggtccaacttgcagaattaattgactgtctagacaaagattattgggaagcagaactctgcaaaattctagaagaaatgcgtgaagaaatccaccgacacatggacataactgaagacctgaccaataaggctcggggcagtaacaaatcctttctggcggcagctaatgaagaaattttggaatccataagagccaaaaagggagacattgataatgttaaaagcccagaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgaggagccaacagaagttggggataaaggtaactctgtgtcagcaaatcttggcgacaacacaacaaatgcaacttcagaagagactagtccctctgaagggaggagccctgtggggtgtctctcagaaacccccgatagcagcaacatggcagagaagaaggtggcatctgagctcccccaggatgtgccagaagaacctaacaagacatgtgagagcagtaacactagtgctaccactacctccatccagcctaatctggaaaacagtaacagcagcagtgaactaaattcttcccagagtgaatctgctaaggcagctgatgatcctgaaaatggagaaagagaatctcatacacctgtctctattcaggaagagatagtaggtgatttcaaatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtactggtagttaactctcaaggagaaatttcacggttgagcaccaaaaaggaagtgatcatgaaaggaaatatcaacaattattttaaattgggtcaagaagggaagtatcgcgtctaccacaatcaatactccaccaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaactgggcatcacatagggcaaattggatcaaggcagttcagatgtgtagcaaacccagagaatttgcattggctttagccattttggagtgtgcagttaaaccagttgtgatgctaccaatatggcgagaatctttaggacataccaggttacaccggatgacatcaattgaaagagaagaaaaggagaaagtcaaaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccagtaagagtaaaacaaaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccaccacgggaggcacactggttacatctatgactgtgagcaaagagtattccacacgagacaaagtgaaactgatgaaattttcaagaccaaagaagactcgttcaggtacagctctgccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaaattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcgtttttattggtcataacagtccaattatattcttggccaattttgtccaacggacaagaaaaaagcaaagtcaacgacaccattatcttgtcaagatcagatggttttactattgtggcagaagcgagaaaactttgtttattgaaaaaaaaagaaaaagaaagcaagaaaaaaagatactatggggtcaagtgtaactccatggaaatgccacgtctgctcttcagtgaagaagctggtttagagtctcacagaaaacttttgactgtatttatttattgttgcaaaaaagacgcttttttattgctgccctcatttgtcagctaattattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaaatgagtaaaatctatttgaaggtatcttgtttgtaaacatttgtcagattctaatttttttcttttgtattaaaattcaactatggatgtatatgaaacaaaataaatggagataatttttctcccaca

SEQ ID NO: 1111 - DNA, 3121 bp, Homo sapiens
atgaacttccaggcgggcggggggcagagcccgcagcagcagcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtggc

SEQ ID NO: 1112 - DNA, 2157 bp, Homo sapiens
gctgggcctggaacacggagcagtggctgccctgcgaggaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagcgttctgtcccgtggtcgggtgcgctgcccctggcacggcgcctgcttcaacatcagcactggggacctggaggacttccctggcctggacagtctacacaagttccaggtgaagattgagaaggagaaggtgtacgtccgggccagcaagcaggccctacagctgcagcgaaggaccaaggtgatggccaagtgtatctctccaagtgctgggtacagcagtagcaccaatgtgctcattgtgggtgcaggtgcagctggcctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgagccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacacgtt

SEQ ID NO: 1113 - DNA, 3081 bp, Homo sapiens
ctccgccgagctctgccccggcgagacgaggcgcctccgtcgccaagccgcgccgtcgcggggctcccgggagcggcccttagcgaccccgcccgggccccctcagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtgtaacccccgtggactatatcttcattgttgtctcctttcctcagtggctagcttgggcactgtacataatgagctctacaagcagcagcattgtgatagagagaagataagtgtgtgtgcagtgaaaagagcagaaacatgcttctcttctcagtttttttccccacttgaagtgcctagagaagaggattaaggagtcctaaggaaaaaagatgctgtttgtacccaatcgaactagttctatatacagaatttcacatcaagataatttgggagactccaggaaatacattcagcttgtccatacctgaaatagagctttttagctaaaaggggagcttttgagaaagttcgactaaaaaagtcagagaagaaactgtggtttcattgccattccaccctcaattagtgcccaggctgaaaatccattttcttctttctcataccttcaaacagacttcacattcttcatctgcagtacctagttcagaactttattatattttgccagacttgtaatagtagcagtaaaaataataatagccaaactaggtgtagtggctcatgcctgtattcccagcagtttgggaggcaaaggcaggaggataccttgagtccaggagtttgagaccagcctgggcaacatagtgagacctcacctctacaaaaaaataaacaaaattggctgagcatagtggcatacgcctgtcatcttagctactcaggaggctgaggtgggaggattgcttgaactcgggaggtcaggtctgccgtgaactgagattataccactgtattccaacccgggcagcagagcaagactctgtctcaaaaatataaataaataaaaataataaaataataaatatataaaatatcactcattcaaaaataataataatggcaaaattattggtcacatttttagtgtttcacatggtaatccagttggttttactgcttcagtggctttttatccagtatcttcctatatctcaatctgtcttttccatttccactattttctttttaaaatatgtgtgtctcctttaaattcttaattagttcctcagtacatcacagaatctcatcctgattttatcctctagctctactctgccatttgtatactttgtttttaaggtatattcaattaatcactgttgattactatataaatttcttttactcttcttttcacttgtctatattgtttattccatattgtattattttctctctcctctttatctggataactatttctaatcatactcagatattatcttccctccacagacttccctaggcagtgttaattgcatccttcaccatgctgccatagcactccatacatagtagtttaaaaattatggtatagttagctgggtgtggtggcaagcacctgtaatcccagctgctcgggaggctgaggcgggagaatggcttgaacttgggaggcagaggttgcagtgagccgagatggcgccactatactcctgtgtggacgacagagcaagattccgtctcaaaaaaataaatataaataaataaataaaaattatggtatagttataaaa

SEQ ID NO: 1114 - DNA, 971 bp, Homo sapiens
gattagggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggaaacctttctgcgagtacgagccaaccggcagacccgactgaatgctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatg

SEQ ID NO: 1115 - DNA, 2529 bp, Homo sapiens
agcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagttgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 1116 - DNA, 1733 bp, Homo sapiens
tggctttgctcctctttctgggaaggggttgcccggctgtgctgccaccatgtcttttcgactttctggtggatccaggaggatctgctcgcgaactgggtctggtaggctgtccggtggaggaacaggcttcgtggctgggaatgtgtgtgttggatcgggagcaagaagcagcttttcttgtactcttgagggcatctcttctggaggaagcttctgcaatagcggtggagggttgggaagtggtgcctgtgctggttttcttggcaatgagcacagcctcctctctgggaatgaaaaggtgaccatgcagaatctcaacgaccgcctggcatcctacctggaccatgtgcatgctctagaggaggccaacgcagacctggagcagaagatcaagggctggtacgagaaatgtgagcctggctcttcccgggaacacgatcatgactatagcagatacttctcagtcatagaagatcttaaaaggcagattatttctgcgaccatctgcaatgccagcattgttctacaaaatgacaatgccagactgaccgctgatgacttcaggctgaagtatgaaaatgagctggctctgcaccacagtgttgaggccgacaccagtggtcttcgcagagtgttggatgaactgaccctttgtacaaccgacctggagatacagtgtgagaccctcagtgaggaattgacctacctcaaaaaaagtcatgaggaggaaatggaagtcttgcaatatacagctggggggaacgtgaacgtggagatgaatgcaaccccaggagtggacctaactgtcctgttgaacaacatgagggctgagtatgaggacttggctgagcagaaccgcaaagatgctgaagcctggttcaacgagaggagtgcaacgctgcaacaacagatttccgatcatgagggagcagccacagcagccagaaatgagctgaccgaattaaaacgcaatctgcaaaccctggaaatagaacttcagtccctcatggctgtgaaacattcctatgaatgctccttggctgagactgaaggaaattactgcaatcaactccagcaaattcaggatcagataggggtgatggaggaacaactgcaacagattcgaacagaaacagaaggccagaagctggagtatgaacagcttcttgatgtaaaaatatttttagaaaaagaaattgacatttattgcaacttactagatggagaagaaagaaaaagcaaatccacatgttacaaatcaaaaggatacaggcctgtgaattctggaaatcaagccaaagactcaacagaagaaactattgttaaaacagtggttgaggaactggatcaaattggcaatctcctttcactgagagtccactcagttgaagaaaagtcctctaaaataagcaacattacagtagagcaacgagtaccttctaaagcaccataatgaggaaaaagttatttggaaagaaagaaagaaagagagagagagagaaagaaagaaagaaaggctgcctttgcaaaaatcctactggtcaaataacctaaggaaattattcatttctgttcttaaaagggctagaatttgttctccttctcttccttttctcatgttctatgcatgtaatccttttccagagtagaaaaatcctgctctgtccctaatttttgtttttattttgggggccttttttgacatttcattaaaaattcttctattgcaa

SEQ ID NO: 1117 - DNA, 4290 bp, Homo sapiens
ttccggcttccccgccccgccccgtccccgggcgtctccattttggtctcaggtgtggactcggcaagaaccagcgcaagagggaagcagagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttacttcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagatggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtgacctgttcctccttttttaaatagcagctttattgagatataatttacatacccataatttacatacctgtttaaagtatacaattcagtggatttagtatgttcacagtgttgcacatccaccaccatttctaattcctgaacattttcaccacctcaaaaagaaaccacacacccattggcatgactccccattcccttgctcccagccccaggcaaccactaacatctgtctctaaagattttttttttttttctggacagttctcataagtggaatcactcagtattatggccttttgtgtctggcttctttcatttcatgtgatgttttcaagattcattcatgctgtagcatgtatccatggtatggatatatcacattttgcttatccttttatcagttgatggacagttgggttgtttctacaaaaaggctattatgagtaatgcagccaagaacatttgtgtaccagtttttgagttttcagttgtttgagtttcagatgttttcagttcatttgggtatataccaaggagtggaattgctggttcacatggtagctctatattctactttgtgaggaattgtcagactgttttccacggaagctgcaccattttacatttccactggtaatttatgagggttccagtttccccacatcttcaccaactcttgttatttttcatgcttatggccatcctagttagcgtgaagtagcatctcattgtggtcttctcttccattttttaaaaaagaattttgacctacaccaagcaaggcagagaccagagtcagtcccccttggggagcaatctgtggttttgataatcaccaccttgggatgaacatggctggtgagctgcagagcagttgatttgacttttggggatggttctaggctggatgtgatacagggcaggttttgtctctagagaaagttctcatgaccttcaggtctaatgagattcagatcatcactttggtttggtttgaaatttctttgtttatccagtgaattacaagtagaataaagatctggttctaaattgtc

SEQ ID NO: 1118 - DNA, 753 bp, Homo sapiens
atgagtgagaacgccgcaccagacttttattacgttgccatggatttcggaggtcatgggctctcgtcccattacagcccaggtgtcccatattacctccagacttttgtgagtgagatccgaagagttgtggcaggtggcgtcgtgggcggaatgtttttctgtaccttccccgagatggtggataaacttatcttgctggacacgccgctctttctcctggaatcagatgaaatggagaacttgctgacctacaagcggagagccatagagcacgtgctgcaggtagaggcctcccaggagccctcgcacgtgttcagcctgaagcagctgctgcagaggttactgaagagcaatagccacttgagtgaggagtgcggggagcttctcctgcaaagaggaaccacgaaggtggccacaggtctggttctgaacagagaccagaggctcgcctgggcagagaacagcattgacttcatcagcagggagctgtgtgcgcattccatcaggaagctgcaggcccatgtcctgttgatcaaagcagtccacggatattttgattcaagacagaattactctgagaaggagtccctgtcgttcatgatagacacgatgaaatccaccctcaaagagcagttccagtttgtggaagtcccaggcaatcactgtgtccacatgagcgaaccccagcacgtggccagtatcatcagctccttcttacagtgcacacacatgctcccagcccagctgtag

SEQ ID NO: 1119 - DNA, 701 bp, Homo sapiens
gaggtaaaggccgcgcttgggtgtccctgggtggtcgggtccccgagttgggaggggcggaaggctgaacctccagcttgagccggacaagccgattcccagcgttgagagggtagagatgaactgtgtgtgaggccaaactggatcggtcaacatggtcttccccctccccactccccaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaa

SEQ ID NO: 1120 - DNA, 4114 bp, Homo sapiens
aggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcaggcgagaaactgagtcaaatgaattcagaacatattcccttctctttctcccagggctgtctgtcttttaaggagctgcatgccctgcattcagaagattatggcttagagagcctcattggcacccgagggtccttccagaatcaataaccaccacaaaaatgacaacagggactaggccctactctgcaccccccacatccaccccccaccatttcctaggatggacatatctttcaaggggaaaaaaaaaccatgtctctggggtatttcacaatatattttctttgtatagtgttctttacttaaagaacaagaaatagttttttataaaactttaaaaaggaaaaaaaaacaggcatttataactgagggtatgaacttatatccaccaggtctcttgtccctgcacttcattttctttggaagaaaatgatgtctaaagaacaatatagaggcatttttacatacgtatttaaatgaaaaggaaaatcgtggtttcttaaattgataaggattaagaatattttattataaatataatatatgattttttaacctgttttgttgcctcatatgctgtcaggttaatttgttttccttcgtgccagaggtggggaggaaggcactctgtctgctgggtaaatgcctaaattcactcaccttcatggtttgggggcagcatggtcattgtggatattggttttgtggagttgagggaacttaggatataagttcactccctctatttttctttgtgattcagtttttcaaaaatctttttttcttccctttctccccattgtggaaattacaaatcaaaggcctttttctttaatgtaaagtgtatttatttaaaaaaaatacaaaataaactacaagtctgtctttgtt

SEQ ID NO: 1121 - DNA, 3610 bp, Homo sapiens
ctgcagggtatctggcctaggccccgcccctccccgcccagcgccccgcccctgcaacgtgtaggcctcggctccaacgaggccccatggctccgtccccgccccatcgccccgcccctcccgggagccctgtcttctgccgtgcgctgagtgtccgcgtcgccctcgccgcagtcgcgggcaccccgctcggcgtcggtgcctgagggaggccgcgatggcggccgaggccctggcggcggaggccgtggcgtcgcgcctggagcggcaggaggaggacatccgctggctgtggtcggaggtcgagcgcctgagggacgagcagctgaacgcgccctacagctgccaggcggaggggccgtgcctcacgcgggaggtggcgcagctccgggccgagaactgcgacctgcgccaccgcctgtgcagcctgcggctgtgcctcgccgaggagcggagccgccaggccacgctggagagcgcggagctagaggcggcgcaggaggccggcgcacagcctcctcctagtcaaagccaagacaaggacatgaaaaagaagaaaatgaaggaaagcgaggctgacagcgaggtgaagcatcaaccaattttcataaaagaaagattgaagctttttgaaatactgaagaaagaccatcagctcttacttgccatttatggaaaaaagggggatacaagcaacatcatcacagtaagagtggctgatgggcaaacagtgcaaggggaagtctggaaaacaacgccttaccaagtggctgctgaaattagtcaggaactggctgaaagcacggtaatagccaaagtcaatggtgaactgtgggacctggaccgcccattggaaggggactcttctctagagctgcttacatttgataatgaggaagctcaagctgtgtactggcactccagtgctcacattcttggggaggccatggagctttactatggaggccacctgtgctacggtccgcccattgaaaatggattttattatgacatgttcattgaagacagagcagtgtccagcacagaattgtcagccctggagaatatatgtaaagccatcataaaagaaaagcaaccttttgaaagactagaagtcagcaaggaaatcctcctggaaatgtttaagtacaataaatttaaatgccgcattctgaatgagaaagttaacactgcaactaccaccgtgtacaggtgcggtccattaattgacctttgcaaaggtccacatgtaagacacactggaaaaattaaaaccatcaaaatttttaagaattcctcaacatattgggagggcaatccggaaatggaaacattgcagaggatctatggaatatcctttcctgataacaagatgatgagagactgggaaaagttccaagaggaagcaaagaaccgagatcacaggaagatcgggaaggaacaagaacttttctttttccacgatttgagtcctggaagctgttttttccttcccagaggagccttcatttataatacgcttacagatttcatacgagaggaatatcacaaacgggacttcacggaggtgctctctcccaatatgtacaacagtaaactctgggaagcctcaggccactggcagcattacagcgagaacatgtttacctttgagattgaaaaggacacttttgccctcaaacccatgaattgtccagggcactgtctaatgtttgcccatcgtccacgatcttggagggaaatgcctattagatttgctgattttggagttctgcatagaaatgaactgtcggggactctcagcggcttgaccagagtgaggcgcttccagcaggacgatgctcacattttttgcacagtggagcagattgaagaagaaataaaggggtgtttgcagtttttgcaatctgtttactcaacatttggcttctcctttcaattaaacctgtcaacaaggccggaaaacttcctaggagagattgagatgtggaatgaggctgagaagcaactgcagaacagcttgatggactttggagaaccgtggaaaatgaacccaggagatggagcattttatggccctaaaattgacataaaaatcaaggatgctattggcagataccatcaatgtgctacaattcagctggacttccaactgcctattagatttaatctcacatatgttagtaaggatggggatgataagaagagacctgtgatcattcatcgagccattttgggatcagtggaaagaatgatagccattctttcagaaaactatggcggaaaatggcctttctggctatctcctcgtcaggtgatggtcatccctgtggggccaacttgtgaaaaatatgcacttcaggtatccagtgaattttttgaagaaggatttatggctgacgttgacttggatcacagttgtacactaaataagaaaatacgaaatgcacagctggctcagtataattttattttggtggttggagaaaaggaaaagatagataatgctgtaaacgtgcgaacaagagacaacaaaattcatggagagattttagtaacttctgccattgataaactgaagaatctcaggaagacacggacactcaatgctgaggaggccttttgaagtccttccctgatatttgcttctgtgtaactttgttttgacccttaaaaatgtatttttcttaacatgttagtacttctacgactttggagccactgatgggtccactcatggcctcagctgagaaaggagacgatgaacgtgtagctgacatgcacgaagtttaatttactcatgtccacgggggacgtttagagggcacgtgggaaattttccagcaatcaatgccttgagaaacttaaatggggaaatattattcatcgagaaagtgaaacaaaacactaggaaatgattatgaaatgttagtgattttcaaaagatgggcttcaaataaaagtctgcagagttttttttaaataggagggaaaatcttattttctaatatgtctcaggtatttttatgacttctactaaaattcacactgaaactttatcttctaaactggaatcattacttaattttaactaaccaacaaccacaaaagcagcagctactgctaaatattggattactgacaaaggaattcagttttgtggaatctggtgtttgcactataggttaagagttgccatttaaatgtttcttattcataattaggttttgttccgctttagaaaaaaataaattcccaaatgaattgcatcagtgtttccagcgtttcagctgtgggcttctaccaccactaagccgctcacctagagttgttacttttttgatgggatgacattccatggatttatgtactgaaatggatttcagattttaaagagaggaatgctctacgtgctcagaactgaattaaaatggcattatgtcaatagagaattcagctaccaaacaagaagtattgtttattttgcgatatgctgtgaaattcaaaagaaatgtaagaaataatctcttttcaatatactgatcatttagttaacttcctgagggatgtgaacagtgaaacagttggcaaacaaaacaatatatatcag

SEQ ID NO: 1122 - DNA, 2492 bp, Homo sapiens
gcgggcaggcgactcctgtcccgggtggaggcggcggagccggagccgggggagggggcagcggctgtctcacggaccacggcggcgcccgcagctcctcaccgcagcacccccactgcaggcccgaggagctttccggagcttcccacactcctggggagaagacttcttagccagcttgatgtttaaaattcagctggagcccttaaaacttcgagcgtggacgctgaatgggtttgtaaagtttcgaaacaaggagaccagtgctggtccagtggctgtgatgggaaaagattattacaagattcttgggatcccatcgggggccaacgaggatgagatcaagaaagcctaccggaagatggccttgaagtaccacccagacaagaataaagaacccaacgctgaggagaagtttaaggagattgcagaggcctatgatgtgctaagtgaccccaagaaacggggcctgtatgaccagtatggggaggaaggcctgaagaccggcggtggcacatcaggtggctccagtggctcctttcactacacctttcatggggacccccatgccacctttgcctccttctttggtggctccaaccccttcgatatcttctttgccagcagccgctccactcggcccttcagtggctttgacccagatgacatggatgtggatgaagatgaggacccatttggcgctttcggccgttttggcttcaatgggctgagtaggggtccaaggcgagccccagaaccactgtaccctcggcgcaaggtgcaggaccccccagtggtgcacgagctgcgggtgtccctggaggagatctaccatggctccaccaagcgcatgaagatcacaaggcgtcgcctcaaccctgatgggcgaactgtgcgcaccgaggacaagatcctgcacatagtcatcaagcgtggctggaaggaaggcaccaagatcaccttccccaaagaaggcgacgccacacctgacaacatccctgctgacatcgtctttgtgctcaaagacaagccccatgcacacttccgccgagatggcaccaacgtgctctacagtgccctgatcagcctcaaggaggcgctgtgtggctgcactgtgaacattcccactatcgacggccgagtgatccctttgccctgcaatgatgtcatcaagccaggcaccgtgaagagactccgtggggagggccttcccttccccaaagtgccaactcagcgaggagacctcattgttgagttcaaagttcgcttcccagacagattaacaccacagacaagacagatccttaagcagcacctaccctgttcctaggctctgccccagccagtccagagcctaccacagcaatacccccaacactcactccactcaatgtgcacccagcttgatgtccactggacactggcaactttttctaaaatgcaaaaaaaagccactggttttcaggaaaatgttcctgtccctgaccccttttagagctgggctgcctggggggagtgggagggaggtggggagagctagcccaggccaggggtcaatgttcatgtcactagctttcaatccagtttccactgcagtggctggagagtgacctgagtgctacttgaagatatgtagagattccttatccatgcctgtacatagcatgtcctcctcccctcagctttgctaataccagtcccctcccttccctttggcttcctgctgttgggggtggaaaagactagaaaggacattgctttctcagccccacccccaggtccacagtgtccaaggtaatggcacacatattcatgcacaagaagcactcacctagagctgtctgtgcctctctgggagaaaggagagaggataagaagggaaagttcacaacctgtgaacagggacttgagcacgagacacttttcatctggagcaggggggtgagctcctcagcagcctccgtaacagctgccctgcctacacctgcagagctggaggttctgtcctccctgctgctctcaggagtgttcaagggtggagggcagggaatggggcctgaggtattaaggctaagaggtgggggacagggcccatctaccagccttcatcaggaagggaaagggctttggggtcaggtggcagctattccccaccaagagattcagggtcacaggtttttccccacacctctgaactcagggcctagccacccccaaacttccaaatcccacttttgtgatatgtgaagctactcatttcttacccttggaggctgtgtggggaatttccagcccttttatgcctgtgtgatcccaccccacccccatagttgtataaaggtcatagtgaagaagctgggggaagactgcttcagccagatcctggggtggggtctttaggttttctcactttgacaacccccgaatgtttttatagtagtttttttgtatttttttgtaatgacagtattatgtaaaaaataaagtatttt

SEQ ID NO: 1123 - DNA, 1627 bp, Homo sapiens
agtgcgttacttacctcgactcttagcttgtcggggacggtaaccgggacccggtgtctgctcctgtcgccttcgcctcctaatccctagccactatgcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgtgtttgtagacttggaacccacagtcattgatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggctgaccagtgcaccggtcttcagggcttcttggttttccacagctttggtgggggaactggttctgggttcacctccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatcaaaa

SEQ ID NO: 1124 - DNA, 439 bp, Homo sapiens
cacagcccgcggccccgagcctgagcagatgggcctggcaccctgctgcacccaggcactgtgtggcctggccctgcggcatcacagccacctgcagcagatcagactggagttccatagactttctgaagaaaacactttgttgaaaaacgatctgggaagggttcggcaagagcttgaagctgcagaaagtactcacgatgcacagaggaaggaaattgaggttttaaagaaagacaaggaaaaggcctgctctgagatggaggtgctcaacagacagaatcagaactacaaggatcaattatcccagctcaatgtcagggttcttcaactgggacaggaggcttctacccaccaggcccaaaacgaggagcatcgtgtgaccattcagatgttaacacagagcctggaggaggtggttcgcagtgggcagcagcag

SEQ ID NO: 1125 - DNA, 7018 bp, Homo sapiens
gaggccggcgcgctggcgggcgaggagcggcggcggtggcggccgctggacatgggaaagcggaaccaccaaaaggagtgatgatcaacgatctcatgataaatctggatgctagttctcatgcctcaggacatcctactgggaacgacacaccagctcctgggatcagactttcatctacttaggacccctctttgcccagactactaaagccagtcttcactagccacgaatggctacccaaaggaaacacttggtgaaagattttaatccttacattacctgctatatctgtaaagggtatctgatcaagccaacaacagtgacggaatgcctccatacattctgtaagacttgtattgttcagcactttgaagatagcaatgattgcccaaggtgtggcaaccaagttcatgagacaaatccattagaaatgttgaggttggacaatacattagaggaaattatatttaagctggtccctggactacgagaacaagaacttgagcgtgaatctgaattttggaagaaaaataagcctcaagaaaatggacaagatgatacttcaaaagctgacaaaccgaaagtagatgaagaaggtgatgaaaatgaagatgataaagattatcacagaagtgacccacaaattgctatctgtctagattgtttacgaaataatgggcaatcaggggacaatgtagtaaagggtttaatgaagaaattcattcgatgttctacacgtgtaactgtgggaactattaaaaaatttctaagtttaaaactaaaacttccaagttcttatgagttggatgtgctgtgcaatggtgaaattatggggaaggatcatactatggaattcatctacatgacaagatggcgactaagaggcgaaaactttcggtgtctgaactgctcagcttcgcaagtctgctctcaggatggccctttgtatcagtcataccctatggtactgcagtatcgaccaagaattgatttcggttagaccaaggggcccagacctcactgagatgaatcctgcactatttgtttactcgtcaacagattgcacagttaacggtgtgtggactagaggaacacaaccagattttcagcatgcaaataaggccattgtctatctctaaattgtcagttgcattcatgttgtttctattaggagcaaaccaagtgccattctgctactgaaccatctgcataaggtatttgtgttgtctcaaagtgtgcaagtcatggtaaaaatcagttagctgtgccgccatgattcacccttctgaatattttgcttgcctgttccaagattgttctaatgtttaattacactagtaaaatggctcaatttttgtggtgttgcagttttcacatacttactcttttattcttgtttaaatagcgtactctacaagaaactaataattatatcttgaaattattttgtatggaagtatatttagaaaagtggtttttgagccactgtcttgttcttgataagctttttgtgtgaaaaaaagttcattcttgagtgtgcaagtccttttgccaagaattccaattattctgtaacattagagcacaatataattgtagacattctaagcatctgtccgtgtagtctaccaattgcacaaggaaggcatgttagccctccagattgaaaatgtatgtgacctcttgaactgaagttagattcccaaccattcaaaatgttggcagctgatcacatttacttctgataaaagtaatgtgtaagtaaggttaatcttctttcataatgccttatgacaagcaggtgctgcttcatgaaacgtcattgtatagcccatttcatgtatcattacattgttgctgttatttaatgagtgcattatttctctttttaagttggccttaggtatatgtcattgtggcatgcagagggttatgacgattttaaatattaggatttttagagcacataacattagctattttatggatttcaaaagtctcaaaacagttgtagattaaaactgttagttacctttcacatttccaaactatgtgcataaaatagaataaatgcagtatagaactatgctaaccaaaattaataggttaagggtattttattttaaatcctgtagtaattggggaaatgagaagattattattttatacatgagttcattaagatcagaaatacaaaatgtcctgtattttgcagttttgttaagtcttccattcgttttaggattagtctgcaagtcaaagaaagtcttgttaccttaaattatatgaaaactgtcattttaaatcttttaatatttacagttttcaaaaaccttacttggaaattgctttgaaacaaacaagctaacctttgaaacttaggaaaaaatcttgaaagttaggaaaaatatttgagaaatatgacgagcacaatctgtgtgttacacacatttagtttttatactgcatatgtggtaaatgtgtcacattttccagtaaaatgtatcagaaatcaatgccttctgaatttcaaaatgattcttagaaataagatattgtacaactctagcaaacatacaaagtacagctaaatcttaatatatttcactatgtaaaaggctgaaacttcataattatctgttccttctatctttttttgagtcaaaaagtctattaaatttttctgttgttgttccaactttggtgaaaaaggttatggcaatactttaactttgttttgttacattgtttttgttcttggaatggctcacaagcagaatttaaaaggcagattttcattaactataaatggctgaaaaaactgaatttactatctagctacagaaattatttttctatggtgtgaaactgttcccagacatccctaagaacttttacaaattattataaatttgtcacacctaggtcagcgattaaaatagtgttttgcaaatggaattttaattaactcaaaatgaattaagagtgcattttaaaaatcacaagtgagactttgatgttttggccccccagccaaaacttaatggtcataaatgaattttatctacaaaatctctttaaatttggctggttgccttgtcatatgtaatttcactattttccaaggaaatatataggaagcaattatgaaactgagaatagttttatatagaattcttttatttactgataatgcattaacatttttattgaaatgcaatggaatatgtgccaaaacacgtgaaaagcttacataaagaaaggcatcagttgtcgtttggagaaaggtacacatttttttgatggtcctaagtgatatggtattactactagaatcacagatttcttcaactgacttattttggtatattcaactacagctttctaaggataggactactttcatgtctagtaatacactgtattccccgttaattatcccttaagtcagattgtagaatttgcaagaaactaggtatagaaaaaatgtacaggcaacttttgtggttagctttataaatttagggtgcttataaaatgataaaatgaattctttaaataacctataggaatcatctgaatctgtaacatcagagactaaaactaaaagttttctttaatctgttgtttcttaagcaataaactgaaagacctttacttccataaaagattttgttatctcttttatctgccttagaaattataagtataaaagggtcaagggaacttagatataaagaatgactgtggtttataaacattactttaattgaagtaatcacatcagttaatagagaaatcaaaatatgtatggccttttctctagattagcaaaacagctttacaaagtatgaaaaaataaactaaaatgctcattgatgaggtaatactcagtctggagtacaggtaacttgggtaatgccttttaactactcttagaggagtatattatttctttatacattaaacatctatcccatagtaatgtgccacattttataaacgtaatgactttgctcaactacattacacactcaaatgtaatctaaatttaaactgattatttaaggaaaaaaagtgtgttatataatattgtgaactgtttagctttactgaaatatttaagagaaagtgcctcattactaaagtgcatttctgttttaaatttactgcataaagtttgagttatctgtacctgtctcttatgaatggtttcatatctaaataggctcttgtaagttaatttttttggaagattttcataagaatatagatatcaccaaagacattttacagtaaattaataaccatgttggagagacggttttaacagtttggaggttggaaatttttagattgcaatttaattttatatagttaggcaataaccttgattaattgctaaaatatcaccaaagaaaggctttaaactgaattttcttggtgagatcagtcaaatgcaggcttttcttgcaataatcagaacacacttcctttcaaatatgttcattgtttttcagcatcatctaacagatcttagtaaatctaaatcctcaaagatgagaaagaggtaaacacaacaaatagccttcctctgcatgaaaagtgagagaaatacatactttgaaaagaaagttcagatttttaatttgagagggtttttatttcatggaggcagtgttaactaaaattaagcttagatttagctcctgtattattcataatatgagaaattttattaaaggcagactttggtaaaagtgccaacacacttacttgtatagaaaagacttcattctatgggatttatataagtaagtgctttctctatattcaaaatatttcataaggacctgtggtttttttccccttaaaaagcaactctaggccgggcacagtggctcatgcctgtaatcccagcactttgggaggccaaggcaggtggatcacttgaggtcaggagttcgagaccagctggttaacatggtgaaaccccatctctactaaaaatacaaaaattagccaggtgtggtggcacgcgcctgtaatcccagctacatgggaggttgaggcaggagaatctcttgaacccaggaggtggaggttgcagtgagccgcaattacaccactgcactccagcctgggtgacacagcgagtctccatctccaaaaaaaattcaactcttggtcttgtttctcagcacttagtttattgttattagaatttagccatacagccaactttgacaaaatgggtcacagaacaagcatgtacatcaagaggaagttccatatcccccttgtaccatttctccttgggaactcatgctatgggctaccttaaaggtaaaactcatcttatggagtctttctgataggtcactaggtaaaactccttggatagggtgaaaatggatgcacactctattacatactctggtttatcataaggaattttccagaaagctaagctttatactaataagatattggttggtagtaggaacttcaaaaatgaatgagtttgccataactttaattttctggattagaaacacaaaacttgaaatgcaattatcaatattttgtaatatatattcctacagtttgggtagaaataaggaacatgtctgctagatctggtttatgaaaaagtgaaaaatattaaatacaccagagactcaaaccctttcaaggcacacaataactgttctggatttacctgacaaacctagttgagtagcattttgacagaaaatatcagactgaaagttcattcaaatgtacttaaatgtacaatacagtgttcaatagtttttattgcagtgatgtttttccaataatttaagtaattctcttcctagtataatacagttttcataaataatgtttacttgctttctttatattttcaaataaaattaaaatgctcgagcacttcctttcagaaagttataaaattaaaaataattattttaaatgctcattcaaatgtgtctgtatacttgctatgcccctttttctataattccaaactgagactgatttttcagagatttttaactttaataattttaaatctagaatcaagtgaaacagatatgttaaatactgagtctagttttcttccatcttatggagcttcatggaataagaaactaatctagtgcaaatgaagattaaatatttctgggtgatggagagatagtcaacaaatttatttatccatcctctgcacatcagtccactggagcaggagttctacacattaaaaatgtaatgggatcagcctagcattgtttggtgttcttttgttgtattttttagaatgggggtgggggcctaagtgtccttatgaagctgtggtccacgacaggagcttgttgggggagtaccagggttctgctgctttcctgcatctgagcaacacaacagagatcatcagttttaaatagagtagccctcacaatcaaaatatcatagaatatattgtaaagttatgttgctaattttcctttgaaatataaaatattttaagctttttgtcaaaagtggtaacatcttaatacaaataaaaacctttttgtggttgtaagatttagcttataaatcattcaaattgaagtgaaagaattaccaggtcattgttaatgacttagtctattaagaatatatgtatttttgtaaaggaaaagcacttgtagatatttaatcagtacaagatatgtcttttgcagaaataaaatgctgcttagagattctccttaaatattttttatttttgtgctcaaatgtattttctgttgatctatggaatgttctgtacaaagctgtataattgtactgttgggctagatactttttttttttaatctggacttagccaagtatatttcaccatgttaaaatacagtatctttgttattaaaaattaaattgcataatttattattgtttgtcatctttaatattagtcactgtagattgcagccttcattaaaaatatctcctttaa

SEQ ID NO: 1126 - DNA, 6924 bp, Homo sapiens
ggtagcggggacgcttaggcagggcctgcgcccagtttagaggccaatgcttctcccgtcctttgcatggcacccaagaaggagaaaggaggaactgtgaacaccagttctaagatatgggaaccctcgctcatagctgcacagttcaatcagaacgattggcaggcctccattgcttttgtggttgggaaccagattgaagatgatcttctcatccaagcccttaccgtggctgtccaggtccctcagcgtaaactcttcagtatggtgtcgtggcaagacattctccagcagattaatgaaataaatacacttgttggatctgcttcatctaaaaaggcaaaaaaacctgtaggtggtaatgctcctttatattatgaggtgttaacggcagcaaaagcaattatggatagtggagagaaattaaccttaccactgatagggaaactcttgaaatttcaacttctccagattaaatttaaggaccaacagcgacgggaaaatgaaaagaaggtaatagaagacaaacctaagttagaaaaggataaagggaaagcaaaatctcccaaggagaaaaaggctccaagtgccaagcctgccaaaggaaagggaaaggatcagcctgaggcaaatgcaccagtgaaaaagaccacccagttaaagcggagaggagaagacgaccacaccaatcgttacattgacgatgagccagatgatggtgcccaacattacattatagttgtgggctttaacaatcctcagctattagcaattatggctgagcttggcattcctataaccagcgtgattaaaatatcttcagagaattatgaacctctgcagacacacctggcagcagttaaccagcagcaggaagttcttcttcagtcagaagatctagaagcagaaaaattgaagaaagaaaatgccataaaagagcttaaaactttctggaagtacttggaaccagtcctgaataatgagaaacctgaaacaaatctctttgatgttgctcgacttgagtacatggtcaaagcagctgattttccttctgactggtcagatggtgagatgatgctgaaattgggcactgatatttttgaaaatattgcctgcttgatgtatgacatcctggattggaaaaggcagcaccagcactatttggaaagcatgcagcttattaatgttccacaagtggttaatgagaaacctgtattagaagccatgccaacttcagaggctccacaacctgctgtaccagctcctggaaagaagaaagcacagtatgaagaaccgcaagctccaccaccagtgacttcagtcatcacaactgaagtagacatgagatattacaattatttgctgaatccaattcgagaggaattcatttctgtgcccctgatactgcattgtatgctggaacaggttgttgcaactgaagaagatctcgtcccacccagtctgcgggagccatcccccagagcagacgggctagaccacagaatcgcagctcacattgtgtcccttctgccctcactctgtctctcagagagggagaaaaagaatcttcatgacatatttttatctgaagaagaaaatgaaagcaaagcagtgcccaaaggccccctcctactgaactatcatgatgcacacgcccacaagaagtacgcactacaggaccaaaagaattttgatccagttcaaattgagcaggagatgcagtccaagttgccactgtgggaatttcttcaattccctctacccccaccatggaacaacactaaacgtctagctacaattcatgagcttatgcacttttgtacgagtgatgtcttgagctggaatgaagtagaacgagccttcaaggtgtttacttttgagagcctgaagctctctgaggttgatgaaaaagggaaactgaaaccttctgggatgatgtgtgggtcagattctgaaatgttcaacataccgtgggacaaccctgccagatttgctaaacagataaggcagcaatatgtcatgaaaatgaatactcaagaggccaagcagaaagcagatattaaaatcaaagacagaacactatttgtggatcagaatttgtcaatgtctgtgcaagataatgaaagcaaccgagaaccttcagatcctagtcagtgtgatgctaacaatatgaagcattctgacttgaataatctcaaactctcagtccctgataatagacagctgttagagcaggagagcatcatgaaggctcagccccaacatgagtctctggagcagaccacaaacaatgagatcaaagatgatgcagtcacaaaggctgattctcatgaaaagaaacccaagaagatgatggtggaagcagatttagaggacataaagaaaacacagcagcgcagtctaatggactggagttttactgaacattttaaaccgaaagtactgcttcaggtccttcaagaagcccataagcaatataggtgtgttgattcttactaccacacccaagacaactctttacttttagtctttcacaatccaatgaatagacaacgtttgcattgtgaatattggaacattgctctccactccaatgttggattcaggaattatttggaacttgttgcaaaatctattcaagattggattacaaaagaagaagctatatatcaggaatctaaaatgaatgagaaaatcatcaggaccagagctgagctggaattgaaatcttctgctaatgccaaacttacttctgctagcaaaattttttccattaaagaatctaaaagtaacaaaggaatcagcaaaacagagatatcagatcaagaaaaagaaaaagagaaggaaaagattcctttcattttagaaggctctctcaaggcatggaaagaagagcaacatcgattagcagaagaggagcgcttaagggaagaaaagaaagcagagaagaagggtaaagaagctggtaaaaagaaaggcaaggataacgcagagaaagaggatagtaggtctttgaagaaaaaatcaccttacaaggagaaatctaaagaagaacaagtcaagatccaagaagtaacagaagagtccccccaccaaccagaacctaagataacttacccgtttcacggatacaatatgggaaatatacccactcaaatctcagggtcaaattactacctgtatccttctgatggggggcagattgaagtggaaaagacaatgtttgaaaaaggcccaacttttatcaaagtgagagtggtaaaggacaaccacaattttatgattcatttaaatgaccctaaggaaattgtgaaaaaggaagagaaaggggattattatttagaagaggaagaagaaggagatgaggaacaaagtcttgaaacggaagtatcagatgcaaagaataaagctttcagcaagtttggatctttttctgccaccttagaaaatggaatctgcctctcgataagttactatggatcaaatggaatggcaccagaagataaggatcctgatttagaaacaatattgaatatcccttcagcactcactccaacagtggttcctgttatagtgaccgttcctcaaagcaaagctaaagggaaaataaaaggcaaagaaaaacccaaagaatcccttaaagaagaagaacacccaaaagaagaagagaaaaaggaagaagaagtagaaccagaacctgttttacaagagactttggatgttcccaccttccagagcctaaatgtgtcttgccccagtgggctcctgttgactttcattggacaagaatctacaggtcaatatgttatagatgaggaacccacctgggacatcatggtccgtcagagctacccccagagggtgaagcactatgagttctataaaacggtgatgccacccgcagagcaggaggcttcaagggttatcaccagtcaaggcactgttgtcaaatatatgttggatggatccacacagattctctttgcagatggtgctgtgagcaggagtcccaattcaggtcttatttgtcctccttctgaaatgccagcaacgcctcacagtggagatttgatggactctatttctcagcagaaatcagaaacgataccatctgagattaccaacacaaagaaaggaaaaagtcacaaaagtcagtcatcaatggcccataagggtgaaatccatgaccctcctccagaggcagttcaaactgtaactcctgtggaggttcacataggcacctggtttacaaccacacctgaaggaaatcggatcggcaccaaaggattagaaagaatagcagacttgaccccattgttatcctttcaggccacagatcctgtcaatggaacggttatgacaactcgagaagacaaagttgtcatagttgaaaggaaagatggtactcggatagtggatcatgctgatggtaccagaatcacaaccttttatcaagtttatgaagatcaaattattctgccagatgatcaagaaacaaccgagggtcctcggactgtcaccaggcaggtgaagtgtatgcgggtagaaagctcacgctatgccactgttatcgccaactgtgaggacagtagctgctgtgccacctttggagatggaacaactattattgcaaagccacagggaacataccaggtgttacctccaaacacaggctctctttatattgacaaggattgttcagctgtgtactgccatgagtcaagcagtaatatatactatccttttcaaaagcgtgagcagctgcgagctggcaggtacatcatgaggcatacttcagaggttatctgtgaggttctggatcctgagggaaacacttttcaggtcatggctgatggtagcatatcaactatattacctgaaaaaaaattggaagatgatttaaatgagaaaactgagggctatgatagtctgtcctctatgcaccttgaaaagaatcatcagcaaatctatggtgaacatgtccccaggttttttgttatgtatgctgatggatcaggaatggaacttcttcgagacagtgacatagaagaatatctatctttggcatataaagaatcaaatactgttgttctccaagagccagtgcaggaacagccaggcaccctaaccatcacagtccttcgccctttccatgaagcatcaccatggcaagtaaaaaaggaagatacaattgtccctcctaatctccggtcaaggtcatgggaaacatttccctcagttgagaaaaaaactccaggacctccgtttggtactcagatttggaaaggcctttgcattgagtccaaacagctagtgagtgccccgggtgccatactcaagagccccagtgtgctacagatgcgccaattcattcagcatgaggtcataaagaatgaggtgaaactgaggctgcaggtttcccttaaggattacataaactatattctaaagaaagaagatgagctgcaggaaatgatggttaaagattccagaactgaggaggagagaggcaatgctgctgatctcctcaagctggttatgtctttccctaaaatggaggaaactacaaaaagtcatgttactgaagttgcagctcacctaactgatttattcaagcagtctttggctacgcctccaaaatgcccaccagacacatttggtaaagatttctttgaaaagacatggagacacacagcatcctcaaaacgctggaaagaaaagatagacaaaacgaggaaggaaattgagacaacacagaattacctaatggatattaagaaccgcataataccacccttttttaaatctgaattgaaccagttatatcagtctcagtataatcacctggacagtctttccaaaaaactgccttcttttacaaagaaaaatgaagatgcaaacgaaacagctgttcaagatacatctgatcttaatctagatttcaagccacataaggtttcagaacagaaatcctcaagtgtgcctagtcttccaaaaccagagatttctgcagataagaaggatttcactgctcagaaccaaactgaaaatttaacaaaatctcctgaagaagcagaatcttatgagcccgtgaaaattccaacccagtccttgctgcaggatgttgcgggacaaacaagaaaagaaaaagtgaagttgcctcattatttgctgagttccaagcctaagtctcaacctcttgcaaaggtgcaagattctgttggaggaaaagtgaacacatcctctgttgcatctgctgccattaataatgcaaagtcatccctttttgggttccatcttctcccatcatcagtcaagtttggagtgcttaaggaaggacatacctatgccacagttgtaaagctcaagaatgttggagtggacttctgcaggtttaaagtaaagcagcccccacccagcacaggactgaaagtgacttacaaacctggacctgtggcagctggtatgcagacagaactgaatatagagttatttgccacagctgttggagaggatggggccaagggatcagcacacatctctcacaatatcgagattatgacagagcatgaggttctgttcctacctgtggaagcaactgttttaacaagcagcaattatgataaacgaccaaaagactttccccagggaaaagaaaatccaatggtccagagaacttctacaatttattcctccacacttggagtcttcatgtctcgtaaagtttctccacattagtttcttctcggtacaactcaatagcctccataatcctctcagcctacagaggatgagaaaggaaagaagtcatcacaacatactccatcatcccaggacactgaaactggaagaactgaccagaaatttgccaaatgaaatagcttcaatctgtttaataaagacgtgcgaatagagtgccaaaaa

SEQ ID NO: 1127 - DNA, 7582 bp, Homo sapiens
agacagtaaggagccaggggaacagagagaattgtggggcagcaccgctccttgggtccccactccccatttctcattgcttggaaatccatgccaagatgcctgccttccttggtctaaagtgtctggggaaattgtgcagctctgagaaaagcaaagtcacctcatctgagagaaccagtgccaggggctcgaacagaaagagactgattgttgaggaccggagggtctctgggacctccttcaccgctcataggcgtgccactatcactcatttgctgtatctctgtcccaaggactactgcccacgtgggcgtgtatgtaacagcgttgatccttttgtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 1128 - DNA, 2686 bp, Homo sapiens
tgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgca

SEQ ID NO: 1129 - DNA, 5427 bp, Homo sapiens
cgcggcttgcaaggcgcctgcgactcggtcccaggtcggcgggcggcgcacggcgggctcgcgcgggggccccggcgcgccgggcggcgcagtacgcagcgcgcggacccacgccacggccaggagcccagagcagcgcggccacactgcccaggggtcggccctcggccccggcgctcggagcgcggcggctgcctgggctttaatggctgctccgcggagcagcgcctagggctggaaggcggctgcggctcaggaagtcacccgagcaagcctccttcggggccggccgcacccgccgcggcgcgctccatgggggcgcgctccccccgggcggcccgctgacccgggacgccggggcccgctcgctcgccggccgcgcgtcccggccatgaactgagcccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctgcaccatgaactaccagcagcagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaagatgccttcgtgaacagccaggaatggacgctgagtcgatctgtcccggagctcaaagtgggaattgtgggtaacttggccagcggcaagtctgccctggtgcaccggtacctgacgggcacatatgtccaggaggagtctccggaaggtggcaggttcaagaaagagattgtcgttgatggacagagctatctgctgctgatcagagatgaagggggccccccggaggcgcagtttgccatgtgggtggacgctgttatatttgtcttcagcttggaggatgaaataagtttccagaccgtttaccactactacagtcgaatggccaactatcggaacacgagcgagattcctctggttctggtgggaacccaggatgccataagttctgctaacccgagggtcatcgatgacgccagggcgaggaagctctccaacgacctgaaacggtgcacgtactacgagacgtgtgctacatacgggctgaatgtggagagggtcttccaggacgttgcccagaagattgttgccacaaggaagaagcagcagctgtccataggaccctgcaagtcgctacctaattctcccagccattcctccgtctgttccgcgcaggtgtctgccgtgcacatcagccagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacctctcggaaagggagcgacccagacaaagagaagaaaggcctggagagtcgtgcggacagcattgggagcggccgagccatcccaattaaacagggcatgctgttgaagcgaagtggcaaatcgttgaataaagagtggaaaaagaaatatgtcaccctgtgtgacaatggcgtgctgacctatcatcccagtttacatgattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcagacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaagtcccggctgacgagccagagcgaggccatggccctgcagtcgatccggaacatgcgcgggaactcccactgtgtggactgcgagacccagaatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctggtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatttgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaa

SEQ ID NO: 1130 - DNA, 4050 bp, Homo sapiens
gtgccccccgcgccccgctccggcagctccacgctcgcgcccgccatgccggagcagttcagcgtcgccgagttcctggccgtcaccgcggaggacctcagctccccggctggggccgccgccttcgccgccaagatgccccggtaccgaggggcggcgctggcgcgggaggagatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggattccaaaaaacagctggagaaggcatggaaggactatgaagccaaaatggccaagctggagaaggagcgcgatcgggccagggtgacaggagggatccctggggaggtggcccaggacatgcagagagagcggcgcatcttccagctgcacatgtgtgagtatctgctcaaagccggggagagccagatgaagcaaggtcctgacttccttcagagcctcatcaagttcttccacgcccagcacaactttttccaagatggctggaaggctgcccagagcctgttccccttcatcgagaagctggcggcctcagtacatgcactccatcaggcccaggaggacgagctacagaagctgacccagctccgggactccctccgagggacactgcagcttgagagcagagaggaacacctgagccggaagaactcaggatgtggctatagcatccaccagcaccaaggcaacaagcagtttgggacggagaaagtgggctttctatacaagaaaagtgacggaattcgaagagtctggcagaaaaggaagtgtggagtcaagtatggctgcctgaccatctcacacagcacgataaaccggcccccggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttaggactgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacaattgtctacagatcacatccattctggctggtcaacatgcatgctgtactggctgttaaataaaaatattctgaatgtcactccttttgagggacagcacagccttccctaggcattctcctatattccccagccaaattgtagagtcagatgcacccacatttgcctgtgtccttgatttagcaggaaggaaaggaatagtcagggttgatggatgcccacttctcttctctttctcttggtcaactcaggagccttttagtctgagggaatggagaggcaaagaaagaagggagagtaatagaattgggagggcagagacttaagggttctgcttcccagccctagaaattctatcattgctcagccccaatgagaaagcagatacacctaagccatcatcaaccactaacatctcaacttgccagttgctgggtgctgggccctggcaggaatgggccaagccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagtt

SEQ ID NO: 1131 - DNA, 1470 bp, Homo sapiens
cgcccacccatccggggcaagagccgcgccgcaggagaggcaggctggaccgggggctccccgggcccgcgacccccgccgtgaccccgcagcccccagctcgcccccaagatgatgaagaggcagctgcaccgcatgcggcagctggcccagacgggcagcttgggacgcaccccggagaccgctgagttcctgggtgaggacctgctgcaggtagaacagcggctggagccggccaagcgggcagcccacaacatccacaagcggctgcaggcctgtctgcagggccagagcggggcagacatggacaagcgggtgaagaagcttcccctcatggctctgtccaccacgatggctgagagcttcaaggagctggaccctgattccagcatggggaaggccttggagatgagctgtgccatccagaatcagctggcccgcatcctggccgagtttgagatgaccctggagagggacgtcctgcagccactcagcaggctgagtgaggaggagctgccagccatcctcaaacacaagaaaagcctccagaagctcgtgtccgactggaacacactcaagagcaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggacgagtacttggctgacctgtaccactttgttaccaaggaggactcctatgccaactacttcattcgtctcctggagattcaggccgattaccatcgcaggtcactgagctcgctggacacagccctggctgagctgagggagaaccacggccaagcagaccactccccttcgatgacagccacccacttccccagggtgtatggggtgtcgctggcaacccacctgcaagagctgggccgggagattgccctgcccatcgaggcctgcgtcatgatgctgctttctgagggcatgaaggaagagggtctcttccgtctggctgctggggcctcggtgctgaagcgtctcaagcagacaatggcctcggacccccacagcctggaggagttctgctccgacccgcacgctgtggcaggtgccctcaagtcctatctgcgggagctgccagagcctctgatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggcacagagccagccagagagttggggtcacaaaccctttgctga

SEQ ID NO: 1132 - DNA, 2274 bp, Homo sapiens
cgcgcggtgaccgttggcgccgaggggaggaggcagccgccgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatggcctgggttcctattctccagccccgccgggctgcggcccacactttgtttacagtcttatggtcaggctgagcagtgatgtggcctagcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 1133 - DNA, 2715 bp, Homo sapiens
aggttgttaccatggagatggctaacagctagagcaggctgtcctcggagggagacattccatctccagacacccagagacgctccagaatggaggtcctgagggagaaggtggaggaggaggaggaggccgagcgggaggaggcggccgagtgggctgaatgggcgaggatggagaaaatgatgaggccagttgaggtgcggaaggaggaaatcaccttaaagcaggagacgctcagagacctggagaagaagctgtcagagatccagatcactgtctcagcggagctcccggcctttaccaaggacactattgacatctccaagctgcccatttcctacaaaaccaacacacccaaggaggaacacctgctgcaggtggcagacaacttctcccgccagtacagccatctgtgcccggaccgcgtgcccctcttcctgcaccccctgaacgagtgtgaagtgcccaagttcgtgagcacaaccctccggcccacactgatgccctaccccgagctctacaactgggacagctgtgcccagtttgtctccgacttcctcaccatggtgcccctgcctgaccctctcaagccgaccatcaagaaggaggaaaaggtgctgcctaagaagtataccatcaaaccccccagggacctgtgcagcaggtttgagcaggagcaagaggtgaagaagcagcaggagatcagagcccaggagaagaagcggctgagggaggaggaggagcgcctcatggaagcggagaaggcaaagccggatgccctgcacggcctgcgggtgcactcctgggtccttgtgctatcggggaagcgcgaggtgcctgagaacttcttcatcgacccattcacaggacatagctacagcacccaggatgagcacttcctgggcatcgaaagcctgtggaaccacaagaactactggatcaacatgcaggattgctggaactgctgcaaggacttgatctttgacctgggtgaccctgtgagatgggagtacatgctcctggggactgataagtctcagctgtccttgactgaagaagacgacagtgggataaacgatgaggatgatgtggaaaatctgggcaaggaggatgaggataagagcttcgacatgccccactcgtgggtggagcagattgagatctccccggaagcatttgagacccgctgcccgaacgggaagaaggtgattcagtacaagagggcaaagctggagaagtgggccccgtacctcaatagcaatggccttgtgagccgcctcaccacctatgaggacttgcagtgtaccaatattttggagataaaggagtggtaccagaaccgggaagacatgctggagctgaaacacataaacaagaccacagacctgaagacagactacttcaagcctggccacccccaggctctgcgcgtgcactcgtacaagtccatgcaacctgagatggaccgtgtcattgagttttatgaaacggcccgtgtggatggcctgatgaagcgggaggagacacccaggacaatgacagagtactatcaaggacgcccagacttcctctcctaccgccatgccagcttcggaccccgagtcaagaagctcactctgagcagtgcagagtcaaacccccggcccattgtgaaaatcacagagcggttcttccgcaacccagcgaagcccgcggaggaggacgtggcagagcgcgtgtttctggtcgcggaggagcgcatccagctgcgctaccactgccgtgaggaccacatcacggcctccaagcgcgagttcctgcggcgcaccgaggtggacagcaaaggcaacaagatcatcatgacgcccgacatgtgcatcagcttcgaggtggagcccatggagcacaccaagaagctgctctaccagtacgaggccatgatgcacctgaagagggaggagaagctgtccagacatcaggtctgggagtcagagctggaggtgctggagattctgaagcttcgagaggaagaggaggcggcgcacacactgaccatctccatctatgacaccaagcggaatgagaagagcaaggaatatcgggaggccatggagcgcatgatgcacgaagagcacctgcggcaggtggagacccagctggactacctggccccattcctggcccagctcccgccaggagagaaactaacatgctggcaggcggtgcgcctcaaggatgagtgcctcagcgacttcaagcagcggctcatcaacaaggccaacctcatccaggcccgctttgagaaggagacccaggagctgcaaaagaagcagcagtggtaccaggagaaccaggtgacgctgacacccgaggatgaagacctgtacctgagttactgctctcaggccatgttccgcatccgcatcctggagcagcgcctcaatcgacacaaggaactggccccactgaagtacctggctctggaggaaaagctctacaaggacccacgcctgggggagctccagaaaatattcgcttgatgtccctcctggggcctcagccagagctgccagagaaaggaaacctcttcccgcagcctggctcctgtgttccctctatccagccaatgcctgtttacacagacacctggcctcactgccagcccacctcccctacagccctgtttgttcctgcttctcatgattttcctgtaaataaacacactcttaatttgcc

SEQ ID NO: 1134 - DNA, 1193 bp, Homo sapiens
cagtcagatccatcatgtggccactgacagcccttctgctcctggttccaagcagtgggcaagctgctactctggagaagcccatattgtctctacatccaccttggaccaccatcttcaaaggggagcgggtaactttgaagtgtgatggataccacccactgctcctggagctccagcccatcagcactctctggtatttgggccacctacttctgccctctcacaagaagagcattgaggtgcagacaccaggggtgtatcgatgccagacacggggagcacccgtcagtgaccccatccacctctctgtatccaatgattggctgattctgcaagtgccctatgcgccagtgttcgagggtgagccgctagtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccgctaaggtggctgtgacagtgcaagaagcgcgacacgccgctgcagttcgcgttttacaagtacagccgcgcggtgcgccgcttcgactggggcgccgagtacacagtcccggagcccgaggtcgaggagctcgaatcgtactggtgcgaggcggctaccgccacccgcagtgtccggaaacgcagtccgtggctgcagctcccggggccgggttctcccctggacccggcctccaccaccgccccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaattaaaggagccacaggccctccgggagctcaggggaacgcccgagacccccacctctcactttgctgtgagcccgggaaccccagagaccactcctgtggagagctgagg

SEQ ID NO: 1135 - DNA, 1439 bp, Homo sapiens
gcggcttccggtcccggctcagcctccgacccaggtggtctggagcctgccgggagagtggtggcatctgagaggctggtcgtggactgtggttgggggaggtgggagctgttttaaccgtgtgccccctctcctgtgccggcgtgggcatcccccggggcagtggaacgcgggcgctcctccagcttccgagtccagccagcctgggcgcggggcgccgcccccgagacacccgaggagtccgttcctccctggttacgtggactgtggagctggtctcttgtggctcagcgccgtgcggaggttgaagcgtacctgcggaggtcgcaccagggcgtgaggaggaggaggaagggcatgagccgagcttgaggaatccgtgctccaaactctacactcaagggtggcccttgggtagggtgaagatcccctgtctttatcctagttccacaccttggtgtgggttactgggtgcaggatgaactgtcgctcggaggtgctggaggtgtcggtggaggggcggcaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcacttttgggcctttgggctctggaacctgctctgggtcattggtgagacttggaaggggcagcccccgctggcttcttggttttgtggttgccagcctcaggtcatccttttaatctttgctgacggttcagtcctgcctctactgtctctccatagccctggtggggtcccccttctttctccactgtacagaagagccaccactgggatggggaataaagttgagaacatgagtttgggctg

SEQ ID NO: 1136 - DNA, 2536 bp, Homo sapiens
ctgctgccggcccctcttccccgacggctaataataaacccgggttcctgtttcccggccgcggccactccagattcggggctgaggggctcactctgcaaccaaggcacgtgcattctggtcatcccacgcggggagcgcgcgcaaggcccgcccagcccccacatgccagccccaccctccagtcggtccggacgccgacgcctttttgaccctcgctgtgcccggccctcctcatctggcctgcccagggcttggtgctggcggggtccagctgctccaatccctcctcctctgctctgccctgccctgccctggcctgccccggcgccctccctcagcccgggtatcaggcgagaggcggagctggcccggcgcgccccgcccccgctgtagaaagggccgggcgagtgttactcgcggtcatcccggcctgggccttttatctcggtgctgccgggggaggcgggaggaggagacaccaggggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagctttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaatgtgtcaactaaattggacaagcgtctggtcctcattaatctgccaatgaatggtttcgtcattaaataaaaatcaatttaattgatttactagcaaaagtaaa

SEQ ID NO: 1137 - DNA, 821 bp, Homo sapiens
attctcatccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcggacaggaaggatctgactgccgatgcacaggagctgaaaggggagctatactgcctgccatgccatgataaaatgggggtccccatctgtggcgcttgccgacggcccatcgaagggcgtgtggtgaacgccatgggcaagcagtggcatgtggagcattttgtttgtgccaagtgtgagaaaccctttcttggacatcgccattatgagaggaaaggcctggcgtattgtgaaactcactataaccagctatttggtgatgtttgcttccactgc

SEQ ID NO: 1138 - DNA, 2600 bp, Homo sapiens
gaactgggccaagcgcccccggaggcgctaagcttgcgccctgaggcggtttccgttcccggacgtttggactctgtcctggagaaggggaaggaaaaagtaagacgtagaagtacactgagacttcgtcacacataaaacaagcacgacaaagaaagagggcgcgaagggactcctggaagaaattgagtctacatttaagatcaccctaaaagtagtgacggcctcttcattactccaaaccccagatttaagtcggtaggacgtcttcgcgttgacttgtggggaatgtagtttcgatgctgccggcgcgttttgtttgcgacagaaactacaacccccaggggccaccgcgacgttgcctgtgggtgcccgcgaaccaacggttagcggtggcaggggctgactgagagcgtctgcttgtgcctggtacctagtacaaacttaataaatgtgtgacgcaagaataaaggaatgaatgaatggaagaatgatataatgccacagaactttcaaagatgggactgtctagttgcaaaaacaagctcagggatcccactgattctactttacgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctgg

SEQ ID NO: 1139 - DNA, 2221 bp, Homo sapiens
cgccgcagcgcgcgcccttcccctcctcaccgctacctgctccggttccggcgctcggccgctccgttgccctcgggcgccttggttgcggccctccgctgaggagccatcggaccaggccgccgcggagccgggccggacgcgggcgccaggcccggggacgaacgccgtaacagggagcgcgaggcaggcacggcgcagggacgcgagtgcgacgcgctcggccatcggcccctgggctggcggccaggcccgagcaatcggcggccgagcggggcggggctcagagcggaggcggcggccgcgagggcggggcggccgggcctggctgcgcccccggacctcgcgggaccgcggcggcgcaggaagaagtccccaaggagacttcgccataggagttcacaggaaatattgaaatgtcaggttccactccatttcagatgagattagttcatttagaccttaaaggagctccaccaaaggtctcgtacctctcagagatttttcctctgttccgtgcgctaggtgcaaacggcctcctcattgagtatgaagacatgtttccctacgagggccctctgaggctgctgagggccaagtacgcctacagcccctctgaaatcaaagagatcttgcatctggctggactcaatgagctggaggtgattcccttggtgcagacatttggacacatggagtttgtgctgaagcacacggccttcgcccacctgcgggaggtgggctccttcccctgcaccctgaacccccacgaggcagagtccctggcgctggtgggcgccatgattgaccaggtcctggagctacacccaggcgcccagcggctgcacatcgggtgtgatgaggtctattacctcggagagggggaggcctcgcgccggtggctacagcaagagcagaacagcacggggaagttgtgcctgtcacacatgcgggcggtggccagcggcgtgaaggcccggcgccccagcgtgacacccctggtgtgggacgacatgctccgagacctgcctgaggaccagctcgcagcgtccggggtgccgcagctggtggagccggtgctctgggactacacggccgacctggatgtgcacggcaaggtcctcctcatgcagaagtaccggcggtgcggctttccgcagctgtgggcagccagtgccttcaagggtgccacggggcccagccaggccgtgccccctgttgagcaccacctcaggaaccacgtgcagtggctgcaggtggcgggcagcgggcccacggactcactgcagggcatcatcctgaccggctggcagaggtacgaccactactctgtgctgtgcgagctgctgcccgcaggagtcccgtccctggccgcctgcctgcagttgcttctacgcggaggatttgatgaagatgttaaagcgaaagtggagaaccttctcgggatttccagcctggaaaaaacggaccctgttaggcaagcaccctgcagccctccctgtccccttcttcccctccccttcccccgcccgtggagacagctgttctcagcagggctctccgcagggagggggccggctccttccctggcagcaacatccttgcccttgtcacacaagtcagcctccatctgcgcagctctgtggatgcgctgctggagggcaacaggtatgtcactggctggttcagcccctaccaccgccagcggaagctcatccacccggtcatggttcagcacatccagcccgcagcgctcagcctcctggcacagtggagcaccctcgtgcaggagctggaggctgccctgcagctggctttctacccggatgccgtggaggagtggctggaggaaaacgtgcaccccagcctgcagcggctgcaagctctgctgcaggacctcagcgaggtgtctgcccccccgctgccacccaccagccctggcagggacgttgctcaggacccctgaggggagagctcatgccagggggctcctgctggaggctgggggggctctgcactgccaaatggcctgggcaatacgggcccacgtgggcgtcgtgccctctggcccagcagtgtcttgcccacactcagttcctgagggccctgggcagcccctgggggagagactagaaaacacagaaggaagcagcacagggagacccgctttgtgatctgcatgtgtgacactgattctttggaaataaagagtggaagctgc

SEQ ID NO: 1140 - DNA, 5778 bp, Homo sapiens
gagttcatttgctcgcgtgcaggggaagtctggagaaggcattgtttcaattattaaaagtgtgggggcagtgggcggaacaaacgcgccgactacagaggctggacgtaagcttagcggtggcgcgcgtgcgcagcgccggcccgagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataaggccacgggaagaatctctggcagaaaagaagtacacctctcaagggcagggggacttagacagtgtgctctcccagttgaattttacccatactagtgaggaccttctgcaggcagaggtgacttgtcttgaaggcagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgaggcaaaagagatttcactagcagacctccaggagaattatattgaggcattaaataaattagtgtctgaaaatcaacaactacagaaagatttgatgaataccaaatctcagctggagatttctactcagatgtgcaaaaaacaaaatgacaggatctttaaaccaacacacagcagaacaactgagttcaagaatacagagttcaagccaacccatggccagcacagacatgatggaataaagactgagcactacaaaacagatcttcattctccaagaggacaagcgtcggatagtataaaccccatgtctagggtgctaagccccctgagtcctcaaatcagcccttgcagctccaccaggtctttgacttcctactctctatgtaaaactcattctttgccttcagcgctagatacaaatgaagccaatttttctgacactatgtctgagagtatgaatgaccaagaagagtttatatcttcgtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcactatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagacttttttctcatacgaatatttattatcataaagtgatacttaccttgctgacttaaatgtgaatagctatgtactaattgaaataaggattttatgatacatgttgaaaataaagtaactgcaggaactttctttaggggaaatgtgtagaagcatggatttaggggtcaaacatacctggatcgatagactggttttgccacttaccagccaacggggcttgttatttactgggctggtagcccctcctagccaaggggctggtagtgtgtaaagtcaggctggtagtgaataaggggggggtgtgctaaagaaccttatcaagcagtcctctcttgctcaacactcatgcagaggagagaggcagggagggcaagggactggctgtcatgcacggtgcccatggaatatccattggaaataaatgttcatcgtctgcactgctgaggacaagtttagatgggagacaaagatctggatgttgatgtgccgcaggcatttgaaacgatgggagttgataagatccaccagggaggctgtggagagagagaggagcaggaggctgggtttggggccctgaaagatgccagcatctgaggatcacaggaaatagatctagcaaaggaactagaatgtgcagttacagatgagaaaggtcagtgtagtgtacttgccagctcaagggtgtggcctctgtgaaccctctttctgtagtggatctttcccatcagcgtaaaacatcctgttatttcccctttttaaataaaacctcagttttttttaatgcctctcttttactgctctgtatgtttgcttcccttcacccaaacacttctggaaagagttgtctgcagtgactctttccagttcctcaccccgccccaccgtagttctcttcctaaccctctccaacaccacttccatccccagactgctttcttgctcttgagttcaccagtgacctaatcagtgtctgagcatcattcagcacagttggactctctcttggcttctgtgacctggaacttctggtttcctctctacctcatcctccactccatctcatggcttttcctcttctaacctctaagtcagagggccccctagagctctgtcatgggttttctccctcagcattctcttccctagaagtttccattccattctcaagctcttaataccacctataggccagtgacccttacatttattactaatcttgacctctccccagagctgctgtcttagatacctagctgcttatgcgatgtcttcacttggatatctgacaaacatcttgtttccaagagagaactctttattctccctcttgctaagattccatatcaggacatagcattatgtttgccagttcctaggagttacttataattccttccttacccacatccgcatatccagtcatttgggaggtcctgtcatttcttcccccagaatcttatctcagacccaaccgtttccctcctgcacttctaccacctgatccagactacttctctctcaccctgattctggcagtagcctcctaactgatagtactcacaccagtaattcagggagcttctggagttatcctttagaaatgtaaatgaaacagtgtcaccactgcttcccttcagactcttccaaggcttctctttttttttttattgagacagagtctcactctgtcgcccaagctgcagtacagtggcaggatctcggctctctgcaacctccacctcccgggctcaagtgattctcctgccttagcttcccgagtagctgggattacaggcgcatgccaccaggcccagctaatttttgtatttttagtaggaacagggtttcaccatgttggtcaggctgatctcgaactcctgacctcaagtgatccacccgcctgagcttcccaaagtgctgggttataagcgtgagccactgcacccagccccaaggcttcttactgcactcagaataaaatccaaatgaattagtatagcctacagagtgtcaataatctgggcctaatcacccattgcatcatcctttactgtgctccacccatgctggcgtcctttctgtttattgagtgcagcaagctttaacctgttcgggtctttcatttgcagtttaccctgaatattccctttctcttacctcacctttgattggcgttttcccccttgcagacctgcactctggcatcctctcctgagcaagccttctttgattgctgcctcccaaacctgtttctccccatttctctagctcattggcctgtgttacttgcttcatagtgctcactactatctgaaatcatttcattacttgatttatgtttgtactgtctatttctgtctttagaattaaaactccttgagggcaaggactttgcttctctggttcatggtgggatcctcatcacccagcacaagcccaacacttaggagaggctcagctagtttgaaccaatggaaaatgccattcctgaggtgcaccacatcgtttcttttgtgttggtgtgcatgctgtccttcagtttgtctcctcttcccacaccctgtcatgtgctcctaaaactccccctttacttggctactttatctggcttggcaaagctttcccatatcccctgacccatgtcagggaacgtttctcctcattgctgtcatggcaccctgtgtgtggctctgaccagactttgctatccgctttgatttctgtctttcaggggctaagtcctgcctacatcctcagtcagcatgctgcctaacacataacagatcctaagcaaatattgggtggatgaaaatcactaccattcaaggcttcattgtatttatcagtaaaactgaaataatatctaatggggtcgagaagatttactgaaaatatatatttgaaagggctttgcagttttaagtactgtacctatgtgcattgctgttacattcaggagatttctgagttttagacagtcccaagcttcagcttaaaatctgtagactgcagcccgtttctgaaacgtttgtactacgtgttgactaggaggaacaatgacagactctgtagtcaccggaaatacttaaggaatcatgaggtactatgtatttccttaaattatactgttttttaaagctgaagtatctaatagttaatgggttgtccaaatttgtcagaacatttgactgtaatttaatgtctcaccatttttcaaaaagatatattaataccaaatattaaaatgtgtcaagact

SEQ ID NO: 1141 - DNA, 5304 bp, Homo sapiens
cccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggt

SEQ ID NO: 1142 - DNA, 3894 bp, Homo sapiens
tgaggggcgaaccaagatggcggcggttttggctgtgtgaggaagacggaagagacggcggcggagggaaaccgacttccactagtccgggtcgcttgggcggccgggggccctcagagtctcccgggcagtggtagcagttgcagcaggatcaggcgcctgtcggcttctgacgtttaaaacagggggagcggaagggagccactggccgcggtggcagggccagggcccctttcctgggcgtctactggcggggcccccgccccggttcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattatgtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgacttttgaataataaaaagaaaagtgaagagtaagagaaa

SEQ ID NO: 1143 - DNA, 3037 bp, Homo sapiens
cagttcgatcaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccagcctgcaagaggaggataaatctaggaaagatgactctgaaagagaaaaagaaaaggataaaaacaaagataaaacctctgaaaaacccaagatcagaatgttatcaaaagattgcagccaagaatacacggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagtcagtttgctcccaggaaagcctttttgtggaaaacaggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccaccacagcagcagccctccccgcagccccaacagcaggtccagccaccgcagccacagatggcaggccctctggtcactcagtctgtccaggggctgcaggcttcctcccagtcagtgcaatatccagcagtctcttttcctccccagcacctcctacctgtgtctccaacgcagcactttcccatgagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacatt

SEQ ID NO: 1144 - DNA, 1960 bp, Homo sapiens
gggccaagacgcccggagcggctgctgcagccagtagcggccccttcaccggctgccccgctcagacctagtcgggaggggtgcgaggcatgcagctgggggcccagctccggtgccgcaccccgtaaagggctgatcttccacctcgccacctcagccacgggacgccaagaccgcatccaattcagacttcttttgggtaaagggccaagagggaagggcgaggcggggaggaagcagctcgggccgccttccctccgtggcctccaggacatccgccggggatagattatgcgtttccattggttacccaccttgagcgagccgtttgatagaaaccaagagcttgaaacgtgcattaggccattgtggactcccagtgggagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcatta

SEQ ID NO: 1145 - DNA, 1363 bp, Homo sapiens
ccgagacctggagcagccaccgccgcaatcatgggcttgtgctggaaaagatgaaatggggaaaatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccagacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 1146 - DNA, 2746 bp, Homo sapiens
agcaatctcgggaaattggagactgacgcggctgctcctgcatgttatttatttttcctctttccctcccgtggagaccctcctgttggaaagagagctgcagcacgggacagagacaggcaggaagaagcagagaggactcggtgacgcccccaccgagcagcccctggcccactcctccagcaggggccatgagcaccaagcaggaggccaggagagatgagggagaagccaggacgagggggcaggaggcacagcttcgagaccgagcccacctgagccagcagcgccggctcaaacaggccacccagttcctgcacaaggactcggccgacctgctcccgctggacagcctcaagaggctcggcacctccaaggacttgcagccgcgcagtgtgatccaaagacgcctggtggagggaaacccgaattggcttcagggggagcctccccggatgcaggacctgattcatggccaggagagcaggaggaagaccagcaggacagagattccagctcttctggtcaactgcaagtgccaggaccagctgcttagagtggccgttgacacaggcacccaatacaatcggatctctgctggatgtctcagccgcctggggttagagaaaagggtcctaaaagcctcagctggggacctggcccctgggcccccaacccaggtggagcagttggagctacagctggggcaggagactgtggtgtgctcggcacaggtggtggatgctgagagtcctgaattctgcctgggcctgcagactctgctttctctcaagtgctgcatcgacctggagcacggagtgctgcggctgaaagccccgttctcagagctacccttcctgcctttgtaccaagagcctggccagtgactgctgtctcagtcagtccccagagggaaagaccttgccttagaagaagaggcgtgtggggaacgggggctcttgaagccaggtagctggggactatggtgtctgcccttccaatcacctccctgacccctgctgtcccattttccccagctggccgcattcctctctgcttctcagcagctgtcctactccccaggacgagttttcactagagggcccacgatgccaggattctgattcatcttcctcccaagaaaagcaaagccaaatcaagaccacagataggaacctaagcacaatggggtgcctgcttgggctgggtcgaaggctctgctgactgctgtccttgtccatcacccaataccaccccaaacacaactcaacttcccacaccaccatgtctctcaccacaccttctgggcctcattatctcccacaactagaccgccatgcctcaccaacctatgtccctggacctcctggtgtctgcctctcggagtctgtgcacatctgctcacagttgagtgggggaagaaacagccagaattcaatacaacaaagagcgggagttagtataggaatgtccatctcataaggctgagagctattttttcctgtggctgcaaatgtctgaagccagttagtttgattaccctgtgcaaaaccttggacatacttctgctattaacgctataggtatttatccgtttccactggctttttgtacccaccgagcccctgagccttgcgtgtgtgtgtgtggaagagccttgtagagaactgctcctgtgaggcagacaggacagtgaggttgtcaccactcagacttcacctattcagcattctttctgatttctagaactatccacctcattaggccttcttcctatccccatctctggcctcttgagcttaagcttgtattgtcctggaatcagtggctttctaaccccctgccaggctttgccaaagcaaaaagacagaggctttttttttttttttaaagtttggggtctgtcaggagacagaggcttttttgaattcactgtgaagagaagaacccgaaccttaagacgccagatccctgagagtctttctggctggtttgagtctctcaaatcatggattaggagtaaagaaagaggccaggcgcaatggctcatgcctgtaatcccagcactttgggaggctgaggtgggtggatcacttgaggtcaggagtttgagaccagcctgggtaatatggcaaaaccccatctctactaaaaaatacaaaaattagccaggtatggtggtgaacacctgtaatcccagctacttggaaggctgaggcataggagttgcttgaacctgggagatgggggttgtagtgagccaagttcgtgccatcggactccagcctgggtgaaggagtgagaccctgtctccaaaaacaaacaaaaaaggagcagagaaagacagtggtacagctaacctgaacaagggaactgggaccgttgggctgaaacagtcttgagcctggggttgactgggttagagaagaaccgggatgcaaggagctgcctgtgacacctggcctgccctttctcagctgcctcccctgccctttctcagctgcctcccctgccctcagaaggaaaggagagggctcacttatcacttgtgccatagcacctggtctcaaaatcctaaaagctttcctcgccctcactgccttgctccacaaggtccactttcctgggtcttgtgctgtgcctttccttgtctgcctcctgctgcttctgtaactgcagaccccaggcccaatggcaagccctcggctcagctgcttctccattggaataaactcttgtttctcta

SEQ ID NO: 1147 - DNA, 1709 bp, Homo sapiens
agacgggcgggggagtcgccccggcggggcaagtccgtaccgcgacatgggcgcgccgagcacgtccgtaccgcaagatggctgctcggacggggacagagctcgcctctgccgcctcgacaactgctcctgggtcctctaagaggaggaagcgccacccatggcacacagtgtcccgtcggcccggccgtacgccaaaatggcggctcccgcgtatttccgctcgcgcgccgtatcgtcttcgccgcctgcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagctgcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgctt

SEQ ID NO: 1148 - DNA, 2128 bp, Homo sapiens
agccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaaaggggtactagtttttaagctcccaactccccctcccccagcgtctggaggattccacaccctcgcaccgcaggggcgaggaagtgggcggagtccggttttggcgccagccgctgaggctgccaagcagaaaagccaccgctgaggagactccggtcactgtcctcgccccgcctcccccttccctccccttggggaccaccgggcgccacgccgcgaacgtaatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattcctttatgcaa

SEQ ID NO: 1149 - DNA, 2633 bp, Homo sapiens
agaaagagataatctgtgaaagccacagagcctgatttctgctgtgataatcttcagcagaccgaggctggggcgagaatgaggcagacctgtttacatggtgtgtgcagtgccttgtggaattcttaactctattttattgtattatttttaatcgaaaagtagatcagatgatagcatgaagtgaatcggctgctttggactaatgggatcttcttttctgcattaagatcaagaacttttctggaatcctctgttctccgagtagccttgtcttctctgtgtgttttatcaatttgaagaacactggcaaaaatcagcaaacttcatctcccaaaaagctctcgctcttttttgccaatacttgaagatttctgctccaaaatctactttgagctgcttgagcatggtggttgataaccgaagggcaaaagcatcacttatttagtgtgtgttatagaaattttttagacaaccttactagctaacccaggtgaccctttacggatttctttcaaagccaatttgaataaacaactcttccctctcaaatgggcaagagtaactcttcagcaccatggagaggtccgggcagcgtgttacaacgtgggactgtgaccagggcaagcactctgacagtgattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcatatcata

SEQ ID NO: 1150 - DNA, 2296 bp, Homo sapiens
actcccccgccctccccagggccctgggaaggggctcagcgtgggaaaggatggttgagttttaaccagaggcaaagcgtgagcgggatcagtgtgtgcggaacgcaagcagccgagagcggagaggcgccgctgtagttaactcctccctgcccgccgcgccgaccctccccaggaacccccagggagccagcatgaagcgagctcaccccgagtacagctcctcggacagcgagctggacgagaccatcgaggtggagaaggagagtgcggacgagaatggaaacttgagttcggctctaggttccatgtccccaactacatcttcccagattttggccagaaaaagacggagaggaataattgagaagcgccgacgagaccggatcaataacagtttgtctgagctgagaaggctggtacccagtgcttttgagaagcaggtaatggagcaaggatctgctaagctagaaaaagccgagatcctgcagatgaccgtggatcacctgaaaatgctgcatacggcaggagggaaaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttatcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagattaaggtgttgtataaataatattcttttggggggaggggaactatattgaattttatatttctgagcaaagcgttgacaaatcagatgatcagctttatccaagaaagaagactagtaaattgtctgcctcctatagcagaaaggtgaatgtacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagtacagtggaaactgttaaatgcataacctaattttcctgggactgccatattttcttttaactggaaatttttatgtgagttttccttttggtgcatggaactgtggttgccaaggtatttaaaagggctttcctgcctccttctctttgatttatttaatttgatttgggctataaaatatcatttttcaggtttattcttttagcaggtgtagttaaacgacctccactgaactgggtttgacctctgttgtactgatgtgttgtgactaaataaaaaagaaagaacaaa

SEQ ID NO: 1151 - DNA, 3126 bp, Homo sapiens
gcggccgcaggggtctgggcagggctgggcagtgctgccggagcaaaagcggtagcgggagcccggccggagctgggtctggagacgccgtggcagcctgaacggagtgtgcgacggattgggaggtttgtctacagattttgagcgttcgaagttgacccctgactaagtatactttgctgctccctcagcctttgaaaaaatgtctgtcacatatgatgattccgttggagtagaagtgtccagcgacagcttctgggaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtagaagcagcaaagaaagcccaccatgcagcgtgcaaagaggagaagctggctatctcacgagaagccaacagcaaggcagacccatccctcaaccctgaacagctcaagaaattgcaagacaaaatagaaaagtgcaagcaagatgttcttaagaccaaagagaagtatgagaagtccctgaaggaactcgaccagggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccgggcatggccatgaactggccgcagtttgaggagtggtccgcagacctgaatcgaaccctcagccggagagagaagaagaaggccactgacggcgtcaccctgacgggcatcaaccagacaggcgaccagtctctgccgagtaagcccagcagtgtgagcagctacgagaagacccagagctatcccaccgactggtcagacgatgagtctaacaaccccttctcctccacggatgccaatggggactcgaatccattcgacgacgacgccacctcggggacggaagtgcgagtccgggccctgtatgactatgaggggcaggagcatgatgagctgagcttcaaggctggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagactaacttttcaagcaaatgcatctgtaaagatgctttagattagactgtcatgtctcagtgtctatctgtatatattatttgatattcagagaatctaaagcactcgtctactgttttaatgagatttaacagcttttaacagtgagtttcgtttgtaaactgcttgaagtctgtggcattcaggcacacgtctggctggccggctgggtctcctcccgggctcagtgggcctggggcctctctgacgtggtgcctgctggagggaggctcgtcgtcaccagctgactgctggtccggcttctgaccggcctttgtcctggctccgtagcagaacactgtaaaagtgcccgcgtctttgcagtagttgcagatttcagtcgtcgtgttacttgtgcacaaacagaagctgggtcttacccgcagcacgagtgtctcgggctgcccggagtcgcccgggagcaggtgctgcagccagagttacgcgggggccacgcgggccggcgggggtggggggaacgtgggggaacctgtgtttcacgtgactcagcagtgcccgccgccgtcaccagctatgcattcactccgtttccagtgagcagatgtcttgcttggaaagtggacctgtgtctgtgtctgtcctgagaacttaccagcagaaatcctcatttctgtgctacggatttaccaaaaattgtcaagtctttttcagtttaacagttcctttacatgtgtagtatttgaggaaaaaaatcaataaacagttgatctcgtgcata

SEQ ID NO: 1152 - DNA, 2186 bp, Homo sapiens
gtcgtggaagcaggactgcgccgcgtcttcctcaaggtggggttcggggggccaccgaatcgctgtcacgccggcaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaa

SEQ ID NO: 1153 - DNA, 3758 bp, Homo sapiens
cttttctgcggctgcactgaagggttcggctgcccatccgtcacagaggcgatgcctctgattggctgctgctcttcgggccgggaggcggggcgggaaggccggagaaactagtttgttggcggcgcctaggctgtatcgcagcgagagcgtttttgcctgtggagagccggccgacgggagccgcggcggagcctgttgagctcgcgcgggctgccgggagtggtctctgaggcggcggcggcggcggggatcgtctccggcactgacgcaccatgtcggtcagtgtccatgagacccgcaagtcgcggagcagcacggggtccatgaacgtcaccctcttccacaaggcctcccacccggactgtgtgctggcccacctcaacacgcttcgcaagcactgcatgttcaccgacgtcacactctgggcgggcgaccgtgccttcccctgtcaccgtgccgtgctggccgcctctagccgctattttgaggccatgttcagccatggccttcgggagagccgggatgacactgtcaacttccaggacaacctgcacccggaggtgctggagctgctgctggactttgcctactcctcacgcatcgccatcaacgaggagaacgctgagtcactgctggaggcaggcgacatgctgcagttccacgatgtgcgggatgctgccgccgagttcctggagaagaaccttttcccctccaactgcctgggcatgatgctgctctcggacgcccaccagtgccgccggctgtatgagttctcctggcgcatgtgcctggtgcactttgagacggtgaggcagagcgaggacttcaacagcctgtccaaggacacactgctggacctcatctcgagtgatgagctggagaccgaggacgagcgggtggtcttcgaggccatcctccagtgggtgaagcacgacctggagccacggaaggtccacttgcccgagctcctccgcagcgtgcgtctggccttgctgccgtccgactgcctgcaggaggccgtctccagcgaggccctcctcatggcagacgagcgcaccaagcttatcatggatgaggccctgcgctgcaagaccaggatcctgcagaatgatggcgtggtcaccagcccctgtgcccggccacgcaaggcgggccacacgctactcatcctggggggccagaccttcatgtgtgacaagatctaccaggtggaccacaaggccaaggagatcatccccaaggccgacctgcccagcccccggaaggagttcagcgcctcagcgatcggctgcaaggtctatgtgacggggggcaggggctccgagaacggggtctccaaggatgtctgggtgtacgacaccgtacatgaggaatggtccaaggcggcgcccatgctgattgcccgctttggccatggctcagctgagctggagaactgcctctatgtggtggggggacacacatccctggcaggggtcttcccggcctcgccttctgtctccctgaaacaagtggagaaatacgaccctggggccaacaagtggatgatggtggcccccttgcgggatggcgtcagcaatgccgcagtggtgagtgccaagctgaagctctttgttttcggaggaaccagcatccaccgggacatggtgtccaaggtccagtgctatgacccctcggagaacaggtggacgatcaaggccgagtgcccccagccttggcggtacacagccgctgccgtcctgggcagccagatcttcatcatgggaggtgacacggaattcacagccgcctcggcctaccgctttgactgtgagaccaaccagtggacgcggattggggacatgactgccaagcgcatgtcctgccatgccctggcttccggcaacaagctctatgtggtcgggggctactttgggacccagaggtgtaagactctggactgctatgaccccacttcagatacatggaactgcatcaccacagtgccctactcacttatccccacggcctttgtcagcacctggaagcacctgcccgcgtgaggagcacctgctgagcccagccagaccgcggccttcagtgtcacagcgtggccttgcttgtctgccacagcgggagctaagccggccctgggccagcactccgagaggtggaaggggccctgccagctctggggagcagcagccttgggctgttctgagctttaggcaagagaagagaagcatctcttgcatccgtgcccctgggggcctcttcagctttgcagtggtttgtgggaagacatacctcccagaggggcatggactgccaccaggactgaccctggcgtcggggagaaggacacttgcagagccttgagatcacctgtttggcaggtcctggactggggccgggcaggcaggggcagggaggcgccccgggtgggctttggggctgcggcactgccacacatcctttccctcctggcctgccctgctggggctctactgccatctatagatggtgtcctgggcctgggaaactaggttcccaggggttgagaccagaaaggtgaccaagacagattttttaaggtgcagaaactgcaggggggcctcagtgacatccatgaggccttattagcaaaggacacccagacctccaaggtttgtgggccccttccacaaagctgtaagtcccagcccacctactcagggccttgctcagtgctgtggcccggtggggacacagttgctcgtggccactcagtggagctgggcctgcagcagactcaaggctccgagtgccctgggggtcacccctcccctcccctcctcagagcccaccctgagaggcagcagtgacccccatggcacacacctgccaacagcactgggggcttctccccaggagaccacgctgccctccaagaccaggagcagctgtgagctggagacagcagagggaccccagggtgtcccctgcagatcccaccagggccgcatccatctcagtgtggaggacagtgacgggaccctcaccatcctcttgcgttttggcccccatttgctccctgagctccaagataagaatggccccgagagaactgctgaacatttgttcattgctgtcacctcctgagtcactggggtccctcaccagcacctccctgacacctgggctatggagaggttggcgcctgtcagtgaccatcctaatgcctctcgctcactcccaagccaccatttgagagggaggggtgttggtgccctgacagggactgggcagggtgtccaaacttggggcttcccaggcacctgcagtgtgaacactgcttggctggctcaagattagggccgcggagggggctgtgcacataccagttacttaagcagccacgagtgtcccccatgccttggtgcgggtcctggaggcctcttgggggtgggacctttgggcagggtttgcccactgacacgcccgccatggggcactggctgcatggggctccttggaccctgtagacccagcagaccccgcctgtgtcaggccagctgcccgaaggcacttggctgtggtcccaggggacggctctgctggcacactcaggagcctggccgcggggactgcagggagggtgcctggacccgtggggttgcttcattgagataaagcacacttatcacatagcacaaaggacgtgccatggtgctttccccaaaagttgtgttgcttttatcagttttctaacttaataaaaagagttgagaaaattc

SEQ ID NO: 1154 - DNA, 1688 bp, Homo sapiens
cgcgcaacggccgggcacccggcggttcaggtcgcttagagagtcgtaggttgggtagtgcgggttggggcgggggctgcggagagggtgcttaactgaggggcatgatgggggaggcggccgtggccgcggggccttgtccgttgcgcgaggacagcttcacgcgcttctcgtcgcagagcaatgtgtacgggctggcaggcggcgccggcgggcgcggggagctgctggccgccacccttaaaggcaaggtgctcggcttccgctaccaagacctccgacagaaaatccggccagtggccaaggagctgcagttcaactacattcccgtggatgcggagattgtctccatcgacactttcaacaagtcaccccccaagcggggtctggttgtggggatcacgttcatcaaggattcaggggacaagggcagccccttcctgaacatttactgcgactacgagcccggctctgagtacaaccttgactctattgcccagagctgcctgaacctggagctccagttcactccgttccagctgtgccatgcggaggtccaggtcggggatcaacttgagactgtgtttctcttgagtgggaacgacccggccattcatctctacaaggagaacgaggggctgcatcagtttgaggaacagcccgtggaaaacctcttcccagagctgacgaacctgaccagtagcgtcctctggctggacgtccacaacttccccggcacgtcccggcgcctctcagctctgggctgtcagagtggttatgtccgtgtcgcccacgtggaccagcggagtcgagaggttctgcagatgtggtcggtcctgcaggacggtcccatctcccgagtgattgtgttcagcctctcggccgccaaggagaccaaggacaggccactacaagatgagtacagcgtgctcgtggccagcatgttggagccagcagtggtgtatcgggacctgctgaaccggggtcttgaagaccagcttctcctgcccggcagtgaccagtttgacagcgtcctctgcagcctggtcaccgatgtggatttggatgggcggccagaagtcctggtggccacctatggacaggaactgctgtgttataagtaccggggcccagagtcggggcttcctgaggcccagcacgggttccatctgctgtggcagcggagcttctccagtcccctgctggccatggctcacgtggacctgaccggggatgggctgcaggagcttgccgtggtctccctgaagggcgtgcacatcctgcagcacagcctgattcaggcctcagagctggtcttgacccggcttcgacatcaagtggagcagaggagacgtcggctacaggggttggaggacggggcaggtgcagggcctgctgagaatgcagcctcttaagcacccatgcacccactcttcccagacctggggcgactcatggcgtgctcacctccagccgctggtggggggtgtcctgaaggacaggatgctctccccagacctccccagggtggtgaagctgtgccctggggccccagctaacccactcctctctctgtacgtcaatgtccctatttgaaagcagggatgatcccattccaccctgtccactctggatgagaattggccacctgatggttatttatacgtccagaagaacatcatttccca

SEQ ID NO: 1155 - DNA, 1622 bp, Homo sapiens
gcactgcgggacatggtgatgtcctgggttggggctgaggaaggcctatgcgcggagggtgcggccttcggctaaggcagaggaccagggttgggtccgtggcggcgggaggggtggcctcctgcgctggtcgccccaggggacctgagaggcgcgacaaacagtcggcgcgtttggtactcgcgcctgcagagctttcaacctccgcgccggctgcgcctgtttctcggccaggggagcaaggccacgcggcctacgcagccgagtcggaaccaaccggttgtttggtgaaacctaccccagagcctcccgcggcccacagagcacagacagaatctccctctgtcacccaggctggagtgcagtggcatgatctcggctcactgcaacctccacctcccgggttcaagcgattcttgtgcctcagcctccggagtagctgggatttacagacgtgcgctaccatgcccggcaaatttttctatttttgcaaagacaggatttcaccgttttgtccaggctggtcttgaactattgacctcaagtgatccgaccgccttgacctcccaaagtgctgggattacggggtgtgagccatcgcgcctggccactttctccaaagttttaaaccaaagccttcttcggcagagctacgacccttcctctatggcccattctatcctatgctgcttccctttataaggacactcccactgttgtgctataatcatctcttggtatctccggactctgccactctgagccctccttacagcctagaaaaaatgacagatctcgtagctgtttgggatgttgctttaagtgacggagtccacaagatcgaatttgaacatgggactacatcaggcaaacgagtagtatatgtagatggaaaggaagagataagaaaagagtggatgttcaaattagtgggcaaagaaacattctatgttggagctgcaaagacaaaagcgaccataaatatagacgctatcagtggttttgcttatgaatatactctggaaattaatgggaaaagtctcaagaagtatatggaggacagatcaaaaaccaccaatacttgggtattacacatggatggtgagaactttagaattgttttggaaaaagatgctatggacgtatggtgcaatggtaaaaaattggagacagcgggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaactaacattccaagggtcaggaaaaaaaccaattatgtatagtcataaaaattacaatttatgatgcaaataatgtaaaatgttttaaagacaaatggcaaataagatatggaccaaagtcactaatgttttacaacagtaacctttactataataaatacttttaaaaaaa

SEQ ID NO: 1156 - DNA, 663 bp, Homo sapiens
atgacatctggagaagtgaagacaagcctcaagaatgcctactcatctgccaagaggctgtcgccgaagatggaggaggaaggggaggaggaggactactgcacccctggagcctttgagctggagcggctcttctggaagggcagtccccagtacacccacgtcaacgaggtctggcccaagctctacattggcgatgaggcgacggcgctggaccgctataggctgcagaaggcggggttcacgcacgtgctgaacgcggcccacggccgctggaacgtggacactgggcccgactactaccgcgacatggacatccagtaccacggcgtggaggccgacgacctgcccaccttcgacctcagtgtcttcttctacccggcggcagccttcatcgacagagcgctaagcgacgaccacagtaagatcctggttcactgcgtcatgggccgcagccggtcagccaccctggtcctggcctacctgatgatccacaaggacatgaccctggtggacgccatccagcaagtggccaagaaccgctgcgtcctcccgaaccggggctttttgaagcagctccgggagctggacaagcagctggtgcagcagaggcgacggtcccagcgccaggacggtgaggaggaggatggcagggagctgtag

SEQ ID NO: 1157 - DNA, 2445 bp, Homo sapiens
ggcaagatggctcccctgcatgtctccggctgatcgctgccgctccgccaatacaatagagccagccactaccagcagcctggccctcttcctccttctccagagagaccaatccagccgaactcggggtttgcctgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagtttt

SEQ ID NO: 1158 - DNA, 6661 bp, Homo sapiens
atgaagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatatagaatctgcaaactgcttcagatcaaacagggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcaagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacacc

SEQ ID NO: 1159 - DNA, 3938 bp, Homo sapiens
agctgctggcccccctgggtccagaggagccttgccgccctcacctgcgcagagcctggagccgacgcgtcacccccagcggaagcgcctcgctgcccgggcgtctggcgaggtgtgcgctccgggtcccagctccagcgcttcgcggcagtcgcccgcctctttccgcaagcagggcggggactgggcggcatctaccgagatctgcgattcgaggcgccgaggagccgaagaccacagctcagctcagacggcgccctagggccgcacagagggtcgggcagtgccggagagaggtttgaaagcgccgccgccaactcgacagcgcgtcccagcgccttgagctcgcttcctcctgctctcaggaaaaactgaggaaacgcgcctggttccaggggtcggcggggaccgtggagacgctgccagcatcctcaacagcttggaaatcccatcaccttggttccctgagacttggaggactagtaggaactgacagctggctgacagaaaacttatccagggagagaagagacaaaagtgaagtgtgaaattttgaataatgttttcagatgctttgcattcagaatagacctctgagttgggacccaagctgtcaactgatcccaaattcctaagttcctgacttgcaggtattgagttctaacctccgaagatggatgaaggtatggaaatttcaagtgaaggaaattccttgatcaaagcagtccatcagagccggcttcgcctcacaagacttttgctagaaggcggtgcctacattaatgagagcaacgaccgtggggaaacccctttaatgatcgcttgtaagaccaaacatgtcgatcaccagagtgtcagtaaagccaaaatggtgaaatacctgttagagaacaatgccgatcccaacatacaggacaaatctgggaaaacggctctgatgcatgcttgcttagaaaaagctggccctgaagttgtttccttgctcctcaagagtggggctgacctcagcttgcaagaccattctagttactcagctcttgtttatgctataaattcagaagatacagagaccctgaaagttcttcttagtgcttgcaaggcaaaagggaaagaggtcatcatcatcacaacagcaaagttgccctgtgggaagcatactactaaacaatacttaaatatgcctcctgtggatatagatgggtgtcattccccagctacctgcaccactccttcagaaatagacatcaaaactgcctcatcgccactttcacattcttctgaaacggaactgacgctttttggctttaaagatcttgagcttgctggaagcaatgatgatacctgggacccaggttcccctgtgaggaaacctgcattggcccctaaggggcccaagctcccccacgctccaccctgggtcaagagtcccccattattaatgcaccagaacagagtggcttcattgcaagaggagctccaggatattacaccagaggaagaactatcctataaaaccaatgggctggcactttccaagcggttcatcactaggcaccaaagcattgatgtaaaagacactgcacatttgctaagagcctttgatcaggccagctcaaggaagatgtcatatgatgaaataaattgtcaatcttatctttcagaaggaaatcagcaatgcattgaagtccctgttgaccaggacccagattctaaccagacaatatttgcttccaccttaagaagtatagttcaaaaaagaaacttgggggcaaatcactacagctctgattcccagctctcagctggccttacccctccaacttcagaagacggcaaagcacttataggaaagaaaaagatcctctcaccatctccttcccaattgtcagagtccaaagaattgttggagaatatccccccaggtcccctgagcaggagaaatcatgcagttttagaaaggcgaggttcaggagctttccctttagatcacagtgttacccaaaccagacaagggtttctcccacccttaaatgtaaattctcaccctcccatctcagatatcaatgtcaacaacaagatttgcagccttctttcttgtggtcaaaaagtgcttatgccaacagttccgattttccctaaagaattcaaaagtaagaaaatgttgttaaggagacaatcattgcaaactgaacaaattaagcaattagtaaacttctaggagatgggtataaaacacatcttcttcaaatgtttatatcagagaaacaaagaactagagaagaaatcttaaatgttcattcttttaaatctcgtgattggttagtccataatggctagatggattaaaatgtaatgtgatttgtactaggcgtcatgagcataaaaaataatacatagtttctgttaagggaattctctcaaacaaaaggaaagcgatttttctcaatgcttctaatatttaacaatctccatgtagtccaaatttgtcattaaaaaaaaatcaaagaaagaaggccacgtatgttggggtaatttttaaaaattttcagattggctaaatattttattaggaaacagttttcaagtcaataatttttttaacatttcatgttaataaatgagattgaaattttttatgatctctaaaccataaaagaaaacaccgacagctgtaaaatgttctaagataaaaaaactcgagctacaaagaaagaatgaactaattctttacaaatgttgactgaagatagataaaactctaattaaaaatttaaaaggttaaacactgtattagaatgggcaactaaaatattcgtggtgtcagtttaattagtgtcaaactggcaagtcagagttttacaacctactagtaatctatgccgggtcttgttgtttgtgcactgtgttttgctttgctttgttttggtttttaaacagacttacctgtaaagttatcttacggaattattctttctccatatcttttaaggaattattctttctccatatcatcttttaattcctgttattagttttggaagcttatccataagtttccaaagacaagatgatataaaagttaaaaagcattcctctttacttatatcaaattattcttgtctttcaaaaagaaccaaaaaaaaaaaattcatcatggataaaaactaagcgcttgccttcttttaaaaagaaaaactgatgattagattaggttagctaaaattaatagaggcagtagaaacttaatcacaaaatgtactaaatatttggcaatattaaacaatgcctttttatttctgatatgtagttattagacatttatatattaaggataacttccttagtgtgacattccaatcatttagtattttaggacctgtgaataacttccaacaaaattaatgaataccatattagtattataaaatattataaagtaataattatatcatctatataacttcaaagtatgatgtttatacaaagaatccttatttcagtctagcagcttaacaacaaaggataaatcagactatacaaaacctaagtgtattaatttgatgattgtcacgtacaactttctttgccttccaagtagaggtgatcctaacaattggcatgatgcttttcttggtaatttgatataagcaagttgtaatgtacatagtaattatttaattactgtggcttttattttaaaaagtaattagaggtttttccatttcatgtcttgaacaacattaatattaattacactagaaatattttttgattcagaacttagaattgtacctgatatttataggtatttaaatgctttctgcaagttaaatatcgagaaaagtacttgacttcaagttgtaaggatacaatttggaagggtatgtaaatagattagttcataaacaaaatggtatcaataaagattttaaatatca

SEQ ID NO: 1160 - DNA, 2441 bp, Homo sapiens
aggagggtgaggggcgggcccagcgagcggacgccgggcgcggcggcgcgcggagaagtgcggcggagcggcgcctgcattagcaggtatgcaaagaagccttttcaccctgatgtccttagagataatatggatcagtccagagttctcctctgggtgaaagcagaaccctttatagtgggtgccttgcaggtcccccctccatccaagtttagtcttcactatctcaggaagatatccacctatgtgcaaatccgggccacagaaggagcttacccgcgcctctactggtctacatggaggcacatcgcttgtgggaagctgcagttggccaaggacctggcgtggctttacttcgaaatatttgatagtctttcaatgaagacacctgaggagcgcctggaatggtctgaggttctgtccaactgcatgtctgaggaggaagttgaaaagcagagaaatcagctttcagtggacacgctacagtttctgctcttcttatacattcaacagttgaacaaggtctccctaaggacatctttgattggcgaagagtggcccagtcccagaaacaaatctcagtctcctgacctgactgaaaaatctaattgtcataataagaactggaatgattacagtcaccaagcttttgtctatgatcatctgtctgatctcctcgagctgcttttagatccaaaacaactcactgcatcatttcattcaacccatagtagtctagtgtctcgagaagctgttgtggcgctcagcttccttattgaaggtacaataagtagagccaggaagatctatccacttcatgaacttgcactgtggcaaccactgcatgcagatagtggcttctcaaagatctctaagactttctctttctacaaactggaaacctggttgaggtcctgtttgactgggaatccatttggtacatcagcttgcctcaagtctggaaagaaattggcttgggctcatcaagttgaagggaccaccaaaagagctaagattgcttgtaatactcatgtggcccctaggatgcaccgactggtagtgatgagccaggtttacaagcagacactggctaagagctcagacactctggcgggggcacatgtaaagattcatcgttgcaacgaatcttttatatatctgctctctcccttacgatctgtgacaattgagaagtgcaggaatagcatctttgtcttgggccctgtagggactacacttcacctccacagttgtgacaatgttaaagtcattgctgtttgccatcgtttgtccatctcttctacaacaggttgcatctttcacgttcttacgcctacacgcccacttattctctctgggaaccagacagtaacttttgccccttttcatacacattacccaatgctagaggaccatatggccaggactggccttgctacagtgcctaactattgggataatccaatggttgtgtgcagagagaacagcgacacaagagtcttccagcttttaccaccttgtgaattctatgtatttattattccctttgaaatggaaggggacacaacagagatacccgggggtcttccatctgtatatcagaaagcactgggtcaaagagaacagaagatacagatctggcagaaaactgtgaaggaggctcatttgacaaaggatcaaaggaagcagttccaggtactggtagagaacaagttttatgaatggttgattaatacaggacatcgccaacagctggacagccttgtaccccctgcagcaggctccaaacaagcagctggataaggatcttacatgcagacactgggccctggaaatacaaggataaatggaggatggtgctcatcttgaaacttgaaactaaattgggaaggtgctattgctgcttaagagacattgggacttttctgtctttttttttttttttttttgaggcagagtcttgttctgtcgcccaggctggagtgcagtggcgcgatctcggctcactgcaagctctgcctcccgggttcacgccattctcctgcctcagcctcctgagtagctgggactacaggcgcccgccaccacgcccggccaattttttttgtatttttagtagagacggggtttcaccgtgttagtcaggatggtctcgatttcctgacctcgtgatccgcccatctcggcctcccaaagtgctgggattacaggcgtgagccaccgtgcccagccttctgttctatttaagaactttgatttccattccattttcatttattactgtttaggccgaattttcgctaaacttctgactttcatataaacatattgcttatagaacatcagaagactcgtctttgtgatgcccaaatgaaaaagttggtgaaggtagtaccattgtatgtatgttaatattaaagcaactgagtgtagatttgcaa

SEQ ID NO: 1161 - DNA, 855 bp, Homo sapiens
ggcggtgcgttcttctacacatgcgcagggttgggcgggtcttcttccttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctggagttaggaggcagattgatagtaggattataataaacattaaataatcagt

SEQ ID NO: 1162 - DNA, 1415 bp, Homo sapiens
gtgacggggaggcggtgcccggggcatctccgcggcggaactcagctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaataaaa

SEQ ID NO: 1163 - DNA, 7179 bp, Homo sapiens
cttcctcattggcgccgtgcagagaggcggaatgttcaactcctaactgcagcggaaacgtgggagccgcgcgggccgctgtcgtcccaacccccgccgccctcgtcgcgcgcggggcctccgcgcccccggctgctgctcacgccccgcccgggagccagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgcttctcttgcctcttgctgcaagaatgtctgaggagtcttactttgaatctaaaacagaggagtcaaacagtgcagagatgtcatgtcagatcacagcaacaagtaacggggagggccatggcatgaacccaagtctgcaggccatgatgctgatgggctttggggatatcttctcaatgaacaaagcaggagctgtgatgcattctgggatgcagataaacatgcaagccaagcagaattcttccaaaaccacatctaagagaagggggaagaaagtcaacatggctctggggttcagtgattttgacttgtcagaaggtgacgatgatgatgatgatgacggtgaggaggaggataatgacatggataatagtgaatgaaagcagaaagcaaagtaataaaatcacaaatgtttggaaaacacaaaagtaacttgtttatctcagtctgtacaaaaacagtaaggaggcagaaagccaagcactgcatttttaggccaatcacatttacatgaccgtaatttcttatcaattctacttttatttttgcttacagaaaaacggggggagaattaagccaaagaagtatatttatgaatcagcaaatgtggtgcctgattatagaaatttgtgatcctatatacaatataggacttttaaagttgtgacattctggctttttcttttaatgaatactttttagtttgtatttgactttatttcctttattcaaatcatttttaaaaacttacattttgaacaaacactcttaactcctaattgttctttgacacgtagtaattctgtgacatactttttttttcttatagcaatacactgtaatatcagaaatggttggcctgagcaacctagtaagacctcgtctctactaataattaaaaaactagctggcatggtagcacacacctgtagtcccagatacttgggaggccaaggcaggaggattgcttgagacctagcaatcagtcagggctgcagtgagccatgatggcaccactgcactctagcctgggcaagagaacaagatcctgtctcaaaaaacaaaaaaaagaaagaattgatagtacaaaatccaacaacaatactgagatgatctaagaaggttataacaaaatgctcttcagaaatacctaagtgctgagaatttttagtactaaagagcacagctgctcaaagtaaagcctgagcagtgttctcagtaatgtatttgaaggaaaaataccctgatttgaaaccaacagcagatgttgcaaactttcataccactgctggccatggaagcctcttaacaacacactgtcatttaaggctgtgcttgtgctttatacaaagagaaagaggtggtcttaaggggatgcttccaggggggtgagttcatgcctctcctgtattttccagcaagtggggtatgtgtggtggtttgttttttagaggggcataataatccaggattctaagcatatgctcagctattttaaagaggaaattaaatattataaaagaaatagtaaagataagttatcctcacttaggcaaaagcacaggtcctttccatatcaagtttagcctaccagggttgttttttgttttaaccctgcttaataatgttggtgttttagaagtagatacaggcactgctctgaaaacctggctagccaaggatattctcagaatgttatcacctgtttgtcaaagcttgtttaaattataaaacacttttaattatatatatgaggcaaaagaactaagacttttttcaaactaaattagaaaggagtgtcattatttgactgttaaaccaaaatatttttggtgggtctttttatggaagtttaaagaaaggacatcatcatagatatgatctaacagtatttctaactatatttgatcattaaaagcctcttggaatttgaagcgtgacgtgtttctaatgccccttgagaggtgaaaaataccacataatgatcagtatgctgtgccagcttcatttggggagaaataactagtagaaagttctgggtgtgaggtgtacagcagtctaggtggcatagtgatgaagaaagggatcagagtctgactgtcactcagaatcctgggctcagttgcttgacaaccttgggaaaattgttttatctttgtgcgtctgtttgctgatcttcagcgtgggaataataacagtacctacttgaaaggatcattgtgcggattaaaagaaataatatatgtaaagcactttaacacagcaccaggcccacggaaagtggctaatgttagctactatgaatggtgccagtgaagacactgaaaaataagtgatttcagtaaccttctggaaagctatcagtttcaaataatattttctctgtagtatgagatgaaattaaaagtggatagctttcaggaaagataaagagaacatgcttagaatgtaagctaaacagattttttctgttgctctttgaaaactatgagccctggccagcttaacctggtctgaggtgagactaaacacaaaaacagtagataaatctctccctaaaagatggattcccccacatacccatgctactagtttctctgtctattcacacatatgtacaaatacatgaacacagcctgtctgtgctcagacatagagaagtactacctgacttgagtcaatgcacccaagaagaaaagcttggagtagagcagaagggagggcttgggactcctgtctttccagcatgccctggggtgcagtggtcagccacctgaagagagagccaatagcatggggtttacaaggcaaagatagtcattcattcaacacatattcatagagctccttctctgtgccagacactgttctggaagatagctagatgaaaatctttgcactcacagagcttacatgccagtgagtgaagatcgatgataaataaagcaaatgcatcatatgttcacatttgataagtatatgccaaaaaatgaagccgggaaggaggacaaggcccatgggtgggtgttgaggtttttaaagtgtggtcaggaaaggccccactgataaggtaacatttgagcaagtctgaaaaaggcaaggggatctttggggctaacttcgggatccctgcactttatgtaagaatgtaaacctggagtctcatttaagaatgatcagcaatacgtttagaacatatgaactgaatgaaatggacattttttcttaatttatgtataaatccatatgattatacataaagttctgatgcattaataaaagcagccaaatagggccaaagagaaaaataacaggactctgtactggacctaactttatcattaattaggtaatattttcctcatttctttactgctgccattttcctcaccagtattccagagatggtcatagctcattactctaccaccaagaacctaaaaggaattagaatacagcagaattggcctcagtgaagagcttaaaattgttctcctcgtagaactggactattgatcattaccacgtgacgttggctctattactttctgttcccaatgtccttctagtggtttgaaaatgttaaaacatccctaaaatctaaatcatataatcagaattctatagtgtcccactctatctgtaaagatcatttggaagactttagactctattaattttaaaaggaatatttattagccatatgcagaatttctaatgatgatattgtacagcttctaattcacttttcagatcagtgtttgaaatggcaattatcagtgttggatttagttccaactacttgatttacaaaaatgtacatttagaggttaaaagaaacagtgagaaatgtaaacattcaaaatgataattgaatctctcagttgtgggaataattatcagagacatgcaactgaaaatgtctcacctttcatctttttttcttaattcataaagttatcttgtagaatttgatgagaccctccctagtcattctcaactggggcggtgctgtcaccgaatggtgtttgagagtgttggggctagggcacatttttggttgtcacagcaactggggtggcatttgctgcccagtgccaggaatagtaacattatgaatgccagggacagtgtgctcagtaaagtcttccatccaaaaggggcagggcacggtggctcacgcctgtaatcccagcactttgggaggccaaggtgggcggatcacctgatgtcaggggttcgagaccagcctggccaacatggtgaaaccctgttgctactaaaaatacaaaaattggctgggtgtggtgtcacatgccagtaaccccagctactagggaggctgaggcaggagaatcacttgaacccgggaggcagaggttgcagtgagctgagattgcaccactacactccagcctggatgacagagtgagacttcatctcaaaaaaaaaaaaaaacaaaaaaaaacaacccggtagcattgtcccttccccactgacaaacttatcaaatccagaagctttagagtttcgtctctaattatttttctcctgaacaaaattacccaagtcaaaacaaaatgtatttttagaattacggcagcatacgacctgaattttgtgagtttcgtggctttatcttaaatcaccatttccctaaaaatggtttctttctccttagaaatgctggtggcaacttgatgaaacagccaaatgcaccagggcaggtcactttcccattacactgattccacaattaaaaaaaaaaaagaaaaaaaactcattgagatagctacagttctataggttaatttaaagcctcctttttctactcatttttgaaagcaaaattacattttactattttacataaccagtgaaaagacgttgaaagcctacagctcactgtttttggtgctctggaaatgttgagggtgggtttttaaccagtgatttttaacgtgcagtgaatttgttagacttttaaacaccagctaaggtagtcaaacttgatccccattaaaaatcaaggaattaggggtcgggggagggtttaggagtgatccagaatgacctcccagaattactgtgcgtacaactttatttttcagagttttcattggaatggtaagagttttatgaaagacagttttaaaacttattctgagttaaatattaatactttaaaaaattattgtactagacttattgcagccttttgaaagtagcagagtttcatcataccacatatataacagagcataaattttctataatcaggcaccttttgctgcttttgagtaagactgttttcctgtttaagtgttaagcatcgccagacataaaaatctattctctcctctcgattgtagcatagcctgacagctctagatacagcatttctatgatgaaaaatgagtatccatcaggaaatctagaagactagccgtgttttctcagactccacctttgtttgcactctgttgcctgtgaggagctttctggcatgtgattatttacttcaaaactagagttccaagcacctacattaattattttatattgtgtgcagaatagtatatcttttaatgtcagatatgatacactgcacatattgcttttgcactcttaaaatttttgtactaaataatagaaaatatttatattctttgagtgtgagctttgaatagatggcattatcactttattgtttttttaacaaaaactttttctcaattattctattgcaatgttattctgagcaagtcctatgccaaatatcttgtataatgtttgtatggaagattaaattttactcttgtgtggtaagactatttcagttactgattttatagttggaatttgatattccagcacaaagtccacagtgtattcagaaatccaagttggtgtcatacatttcattttgatgtgaacttttctttgctttcctttgttctaagactccattttgcaataaacgttttgacagtaaa

SEQ ID NO: 1164 - DNA, 705 bp, Homo sapiens
ctggcttcttggcgcgatgaggttccggttctgtggtgatctggactgtcccgactgggtcctggcagaaatcagcacgctggccaagatgtcctctgtgaagttgcggctgctctgcagccaggtactaaaggagctgctgggacaggggattgattatgagaagatcctgaagctcacggctgacgccaagtttgagtcaggcgatgtgaaggccacagtggcagtgctgagtttcatcctctccagtgcggccaagcacagtgtcgatggcgaatccttgtccagtgaactgcagcagctggggctgcccaaagagcacgcggccagcctgtgccgctgttatgaggagaagcaaagccccttgcagaagcacttgcgggtctgcagcctacgcaaactgaagcaggcccagaccctgatgagctccctgggctgaggagaagggtgttccaggcctgtgtggagccgccctgcccgtatggagtcacgccctctgaactgctcttcgggaggcagccctggttctaggatgctgaggccctggcccggactctggcctcccagatccccagctgcctcacttctctcttgagaacttggctcagggctcctgaggacctttcccagcattaccttcccttcccttgaaaggcaattgttggctgttttcataagcaggaaaaataaacagaagtataaagg

SEQ ID NO: 1165 - DNA, 882 bp, Homo sapiens
ggtggccgatagctggtcctctttctccaacacctagcctgagacttggcggcgcggctgctatcctgaactagcttggtaagtgttgtgtcccgaaccagcgtagagagacctcggaccagccgccttgatgacagcatccgcgtcctccttttcatcatctcagggtgtccagcagccctccatctacagcttctcccaaataaccagaagcttgtttctcagcaatggtgtggccgccaacgacaaactccttctgtccagcaatcgcatcaccgccattgtcaatgcctcggtggaagtggtcaacgtattcttcgagggcattcagtacataaaggtgcctgttaccgatgctcgtgactcgcgtctctacgacttttttgaccccattgctgatcttatccacaccatcgatatgaggcagggccgtacgctgctgcactgcatggctggagtgagccgttccgcctcactgtgccttgcgtacctcatgaaataccactccatgtcgctgctggacgcccatacatggaccaagtcgcgccgccccatcatccggcccaacaacggcttttgggaacagctcatcaattacgaattcaagctgtttaataacaacaccgtgcgcatgatcaactcgccggtaggtaacatccctgacatctatgagaaggacctacgtatgatgatatcaatgtaagccatcccggccagcccctgacatctgccatcgatcttgcaccaagactgaacttgaacactgacattttgttagtaaagaaaaccggatggtgccttgttaaagggcaagaaaaaagggagggggttggagttttgaacgtagtaagccttaccttaatagaattaaattcatgaaac

SEQ ID NO: 1166 - DNA, 4189 bp, Homo sapiens
ttgggggatgccgacgcctgggccttgaggatgctgcggaagctcaccatcgagcagatcaacgactggttcaccatcggcaagacggtgaccaatgtggagctgctgggcgcgccgcccgccttcccggcaggggcggccagggaggaggtgcagcgccaggacgtggcccccggcgctggtcccgcggcccaggctccggctctggcccaagctccggcccggccggccgctgcgttcgaaaggtcactcagccaaaggagctcagaagtagagtatattaacaaatacagacagctcgaagcacaagagcttgatgtgtgtcgcagtgtccaaccaaccagtgggccaggtccaaggccatctttggctaaattaagcagtgtgacatgcatcccagggacaacttataaatatcctgatttgcctataagtcgatacaaggaagaggttgtgtctttgatagaaagtaattccgtggtgattatccatggggccacgggaagcggtaaaagcactcagctcccgcagtatatcttggaccactacgttcagcgctccgcctactgcagcattgtggtcacccagccccggaagataggggcaagcagcatcgccaggtggatcagtaaagagcgtgcctggaccctgggaggtgtggtgggctaccaggtagggctagagaaaatagcaacagaggacaccaggctaatttatatgacaactggagtcctgcttcagaaaatagttagtgccaagagtttgatggaattcacacatatcatcattgatgaagtacacgaacgaacagaagaaatggatttcctgctattggtagtccgcaaactcttaagaacaaattcacgttttgtgaaggtggtcctgatgtcggctaccatcagctgtaaagagtttgcagactactttgctgttcctgttcaaaacaagatgaatcctgcatatatttttgaagtggaaggcaagccccattcagttgaagagtattatcttaatgatttggagcacattcatcatagcaagctctctcctcatctcctggaggaaccggtgataactaaggatatatatgaagttgctgtctctctcattcagatgtttgatgacttggatatgaaggagagtgggaacaaggcttggtcgggggcccagtttgtgttggagcgaagcagtgtgttggtgtttttgccaggtctgggtgaaataaattatatgcatgaacttctcacaagcctggttcataaaaggttgcaggtctatccactccattcaagtgtggctttagaagaacagaataatgtctttttaagtccagtccctgggtacagaaagattattctgtccaccaatattgcagagagttctgtcacagttccagatgtcaaatatgttatagatttttgtttgactagaactttggtctgtgatgaagatacaaattatcagagtctgcgattgagttgggcttctaaaaccagctgtaatcagagaaaaggccgtgctggacgagtgtctagagggtactgttaccggctggtacacaaggatttctgggacaactccatccctgatcatgttgttcctgagatgttgcgttgtccattaggaagcacgatcttgaaagtgaaattacttgacatgggtgagccgagagctctgctggccactgccctttccccgcctggtctgagtgacattgagcgcaccatccttctactaaaggaggttggagcacttgcagtgagtgggcagagagaagatgaaaacccccatgatggtgaattgaccttcttaggaagagttttagcccaacttcctgtaaatcagcaacttggtaaactcatagtccttggacatgtatttggatgtctagatgaatgtcttattatagcggcagctctttctttgaagaatttttttgcaatgcctttccggcagcatctcgatggatataggaacaaagtgaatttctctggcagtagcaagagtgactgtattgcacttgttgaggcatttaaaacatggaaggcttgcagacagacaggggagctgcggtacccgaaggatgaacttaattggggacggttaaattacattcaaatcaagagaattagagaggtggctgaattatatgaagaattgaagactagaatctcacagttcaacatgcatgttgattctcggcgacctgtcatggaccaagagtatatatataagcagcgattcatcctacaggttgtattggcaggtgctttctatccaaattactttacttttggacagccggatgaggagatggcggtgagggagctggctggcaaggaccccaagacaactgtcgtgttgaaacacattcctccctatggatttctttactataaacaactacagtctctctttagacagtgtggtcaagtcaaatccattgtatttgatggtgcaaaagcctttgtggaattctcacgaaatccaacagagagatttaaaacccttcctgcagtatatatggcaattaagatgtctcaactaaaagtttcacttgaactcagcgttcattctgcagaggaaattgaagggaaggtgcaaggcatgaacgtctcaaagctcaggaacacaagggtgaatgtggacttccagaagcagacggtagatcctatgcaagtctcctttaacacatcagacaggtcccagacagttacagatctccttctaactattgatgtcacagaggtggttgaagtgggacacttttggggatacaggattgatgaaaacaactcagagattctgaaaaagcttactgctgaaatcaaccaactgacgctggtgcccttgcccactcacccacatccagacttggtctgtctggcaccttttgctgattttgataaacaacgctactttagagctcaagtcctttatgtttctggaaattctgctgaggtattctttgtagattatggcaataagtctcatgtagatctacatcttttgatggagattccctgtcaatttcttgaacttcctttccaggctttggaatttaagatttgcaaaatgagaccatcagcaaagtctcttgtttgtggcaagcactggagtgacggggccagccagtggttcgcctctctggtgagcggctgcaccctccttgtgaaggtcttctctgtggtgcacagcgtcctgcacgtggatgtgtaccagtactcaggggtccaggatgccatcaacataagagacgtcctcatccagcagggctatgccgagctcacggaggagtcctacgagtccaaggttaatattctcagggctgctattaacaagctagtctgtgatggaccaaatggatgcaagtgtcttgggccagagagagttgcgcagcttcaagacattgcccgtcagaagcttttaggtttgttctgtcagtcaaaaccaagggagaagattgttcccaagtggcatgaaaagccctacgagtggaatcaggttgatccaaagctggtcatggagcaggccgaccgtgagagcagcagagggaagaacacctttctctaccagctccacaaactggttgtgctcggcacctgagcatgtccacaggtggcctccagcacacccctcaggaagctgtggaggctggattccaggctccctccgcagactgactttcctctgtgtctgggtgttacagtctgtgcccactgcatcctaaaggccttttctttcttcttttctctttgggtgatagtcagagagtggtgtttttgttcaggtgggaaggattggaaactctagtcttttctagaaacagaaaatcactgtattaaatattttggaaagattgttctgaaagaagtctgtttggataaagagctgtattttgctttaaatttattaaggtaaatataagtagttaatcttagatgtaaggttccagaatgtgcttacatattctgttctgttacagtgatttaaaccagtagtataggaaaaaacttaaaaaaacaaaaaaaccatgtagtattttctgatttttttttccatgagggaaaatatctaatttttataagactaagttgagttatacttcttggttcacattttggaaatcagagattacagattacatggccatagcttatctgtgttaaaacaataaaagcattaaatg

SEQ ID NO: 1167 - DNA, 987 bp, Homo sapiens
acagttgaagaagcgaccgagggactgggagtcgttagtgaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgc

SEQ ID NO: 1168 - DNA, 2074 bp, Homo sapiens
gccgggccggagcggggtgggtaggggacgcgaggcggagcggggccccacacaggccgcggcggctggctcgggcccctacggtcccggcggcggctggaggaggaagccaggcggctggcggaggaggagagacggaggaggccgagaccggagcgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacagagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcccctcagcttctctctggttttctca

SEQ ID NO: 1169 - DNA, 946 bp, Homo sapiens
gctccagagaggggaaggaaggggcagcagagaggggtcagaaggagggagcttaagccaggcagggttacttgtctctgtgactccttccgcctggcacatgctgcccagctatggggacctttgacctgtggacagattacctgggtttggcacacctggttagggctctgagtgggaaagagggtcctgaaaccaggctgagcccccagccagagccagagccaatgctggagccggtgtcagccctggagccgatgccagcgccggagtcggtgccagtgccgggacccaaggatcagaagcgcagcctggagtcctcgccagctcccgaacgcctgtgctctttctgcaaacacaacggcgagtcccgggccatctaccagtcccacgtgctgaaggacgaggctggcagggtgctgtgtcccatcctgcgggactacgtgtgtccccagtgcggcgccacacgtgagcgcgcccacacccgacgcttctgcccacttactggccagggctacacctccgtctacagccacaccacccgaaactcggcaggcaagaagctggtccggcctgacaaggcgaagacacaggacacaggccaccgccgaggaggaggaggaggagcaggtttcagaggtgccgggaagtctgagccttcgccctcctgctctccctccatgtccacctaggaggctgcctacacctgggcaagggcacccgggctcggctggatttccaggaagacccaccctatgacgactgcccccactcccagaccctccccccagcctgggattgagccctggggatgacccggggttggcaagggaagagctgaaatcgccctgtccttggggaccccaccctttgtgccatctgccgtttccctagtgctgggcatccagtcagccctcaataaatgcttatgaatggatcaacaaca

SEQ ID NO: 1170 - DNA, 2669 bp, Homo sapiens
ctctcccggtgtgggtactgctgtctgtggtgtggctgtgggacccgtgagcaagcagcgacgccagcggcggagaaccgacgaaaggtgtcaccacagtgatggcagtggaggacagcacgctgcaagtagtggtacgggtgcggccccccacccctcgggagctggacagtcagcggcggccagtggttcaggtggtggacgagcgggtgctggtgtttaaccctgaggagcccgatggagggttccctggcctgaaatggggtggcacccatgatggccccaagaagaagggcaaagacctgacgtttgtctttgaccgggtctttggcgaggcggccacccaacaggacgtgttccagcacaccacgcacagcgtcctggacagcttcctccagggctacaactgctcagtgtttgcctacggggccaccggggctgggaagacacacaccatgctgggaagggagggggaccccggcatcatgtacctgaccaccgtggaactgtacaggcgcctggaggcccgccagcaggagaagcacttcgaggtgctcatcagctaccaggaggtgtataatgaacagatccatgacctcctggagcccaaggggccccttgccatccgcgaggaccccgacaagggggtggtggtgcaaggactttctttccaccagccagcctcagccgagcagctgctggagatactgaccagggggaaccgtaaccgcacgcagcaccccactgatgccaacgcgacttcctcccgctcccatgccatcttccagatctttgtgaagcagcaggaccgggttccaggactgacccaggctgtccaggtggccaagatgagcctgattgacctggctggctcagagcgggcatccagcacccatgcgaagggggagcggctgcgggagggggccaacatcaaccgctctctgctggcgctcatcaacgtcctcaatgccttggccgatgcaaagggccgcaagacccatgtgccctaccgggacagcaaactgacccgcctgctcaaagactccctcgggggcaactgccgcacagtgatgatcgctgccatcagcccctccagcctgacctacgaggacacgtacaacaccctcaaatatgccgaccgggccaaggagatcaggctctcgctgaagagcaatgtgaccagcctggactgtcacatcagccagtatgctaccatctgccaacagctccaggctgaggtagccgctctgaggaagaagctccaagtgtatgaggggggaggccagcccccaccacaggacctcccaggatctcccaagtcgggaccaccaccagaacaccttcccagctcccccttgccaccccaccctcccagccagccctgcaccccagagctccctgcagggcctagagcccttcaagaggagagtctggggatggaggcccaggtggagagggccatggaagggaactcttcagaccaggagcagtccccagaggatgaggatgaaggcccagctgaggaggttccaacccagatgccagagcagaaccccacacatgcactgccagagtcccctcgcctgaccctgcagcccaagccagtcgtgggccacttctcagcacgggaactggatggggaccgttctaagcagttggccctaaaggtgctgtgcgttgcccagcggcagtactccctgctccaagcagccaacctcctgacgcccgacatgatcacagagtttgagaccctacagcagctggtgcaagaggaaaaaattgagcctggggcagaggccttgaggacttcaggcctggccaggggggcacctctggctcaggagctgtgttcagagtcaaagcctccaggatacactggccctgtgacccggactatggcgaggcgactgagtggccccctgcacaccctgggaatcccgcctggacccaactgcaccccagcccaggggtcccgatggcccatggagaagaagaggaggagaccaagcgccttggaggcagacagtcccatggccccaaagcggggcaccaagcgccagcgccagtccttcctgccctgcctaaggagagggtctctgcctgacacccaaccttcacaggggcccagcacccccaaaggagaaagggcctcctccccctgccattcccctcgcgtttgcccagccacagtcatcaaaagccgggtgcccctgggcccttccgccatgcagaactgctccaccccgctggctctgcccactcgagacctcaatgccacctttgatctctctgaggagcctccctcaaagcccagtttccatgaatgcattggctgggacaaaataccccaggagctgagcaggctggaccagcccttcatccccagggcacctgtgcccctgttcaccatgaagggccccaagccaacatcttccctccctgggacctctgcctgcaagaagaagcgcgttgcgagttcctcagtctcccatggccgcagccgcatcgcccgcctccccagcagcactttgaagaggccagctgggccccttgtactcccagagctgcccttgagtcccctgtgccctagcaaccggaggaatggaaaggacctcatcagggtggggagagcactctcagcagggaacggcgtcaccaaggtgtcctga

SEQ ID NO: 1171 - DNA, 1065 bp, Homo sapiens
agcagtctttgaaacagctgtaacggcatctgtgaaagaagataggttccaggaacggaactgccacttagattgtaaattcctgaaaaacaggacgtttttgcatctcctcccggcttccccatccctaaaccaacgtctgttgaattaaactaccaaacaaaataactgcagtacagcaatggcgatcagaaggtagaacagctgtatggctgcacattcccatcctccaaagccgatttattgcccctgctgcttccctgggcttctgctttcaccacgcagaatcggattcatcaacgttgactctgtggctgagagaagggcccagcagattaccaggatatgcttcacatcaagtaggagttgcaggagctgtatttgatgaaagtactagaaaaatactggttgtacaagatcgaaataaattgaaaaatatgtggaagtttccaggaggcctgtcagagcctgaagaagatattggagacacagcggttcgagaagtttttgaagagactggtataaaatcagaattcaggtccgtcctgagtattcggcaacagcacacaaatcctggagcttttgggaagtcagatatgtatatcatctgccgcctaaagccatattcattcaccataaatttttgccaggaagaatgcttaagatgtgagtggatggatctcaatgacctggcgaagactgaaaatacaactcccatcaccagcagagttgctaggctgctgctgtatgggtacagagaagggtttgacaaaattgacctgactgtggaagaacttccagcagtttacacaggactgttttataaactctatcataaggaactgccagagaattataaaactatgaaaggaattgattaaattcacatttatatgtttagaaacatgtagactaacgaatgacataagaaatagtggacattttggattgattaaacatctgactgtgattttctaatgtatatgatttccatgaagaaattttgtttctaaacatgcacattttaaaagcctcttttcgaataaagcaaatgcgtgaaaaaga

SEQ ID NO: 1172 - DNA, 7552 bp, Homo sapiens
tgtttgacccggaagtggctgtgttcagctgacagctgctgataaggtggcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccggaaagaagagaagcctgcagaagaacatcctaaaaaagcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaactgatgttctgctttttatggagaagattctgcccatctcccctggacagtagcaggcaggtgagggcagattttacccacttggttgtcacaactgaaccagttctctactccttcccttcacttctgtccactctcaagactttttcccaaaacatgcctgggcactctgcagccgtgaagaatgctcattttgacagaggcccaaatcctgtgtattaggataatatccttccccccgggagccttcgctgcaaacctgttctgccgcatgcaaagactgtgaccatggagttttctcagacaagatttggaaaggcagtggaatgaaatctctttgcagtggcctctctccaaatttccaaagatgactgcatagggaccaacactgcctgactttgcagtatctgtgagaaaaacctgaaaattaattcagggtgaaaatgtggagctctcggcctagtgtaaagtatcaagatgtatatttatgggatagatacatgacttagaagaagtagaagaaaattgtccagaaacagtactgaattttagatagaaaaggctcatgcttcctggagtagggaattgtctttgccatttaatgtgaatgcataaaattaggggaaaaacccaagtggctaagagctgtgttattcctgggaagaactaccaatctagggcacacgtctctctgaattgttgattatgcgctttatgaagagatttttcaatctcgtgtgctttactttgtgtggtttagaccctctgacctagacttttatttttaaactgaaaaagttggtcttgtctatataattgctgcttttacataatttattttcccctctcaggacaaattctgtcttgctccatcttacagcttttccatgttctccaagaaaggtgtggaacattttcattaaacagctgttgctgaggcttctgcttgaccttctgcgtgcccgaatgcacagagaggcaccgaggagagaaaggcttttctcactcgctcccgatgataccgtctctggccattcctgactgaggcagctcactctgaatgggcacctttggagcttttgcccaccacaaggctagtggggtgtttctaacaacacaagtgggacagcttttggcaggcttttcctgaggcctcggcgcttccatcctggacagcaccacttccacatggagctggaatgcaagcaggctgctaattggccttaaaaattctttgtttttttttgagatggagtttcactcttgttgcccaggcttgagtgcaatggcacaatctcagctcagtgcaacctccgcctcccgggttcaagcgattctcctgcctcagcctcgtgagtagctgggattacaggcgtgcaccaccacgcccagctaattttgtatttttagtagaggcaaggtttctccatgttggccaggcttgaactccggacctcaggcgatccgcccgcctcagcctcccaaagtaccgggattacaggcgtgagccactgcgcctggcctaaatttcataacagaaccatgacagcagaatctacctttgcaataagaatgtttcccaggagttagagaccagccctgggcatgatggtaaagaccccagctaattatacaaaaaataattagccgggtaggtggagtgcatctgtggacattcgtggtcccagctactaggtaagctgaggcgggagatcacaagtccaggagtttgaggctgcacgtgacagcgtaggtgatgacagagcgagacactgtctcttaaaaaaaaaaaaaaaaaagtttcccagtttgaatttgtattgctgaagcatttttttgaaatgctatatagatgcctgtcatgtcacagtggcccagtatcaacattttaaaaagctcacttggtagctgggctggtttctattcctgagaaattccagaatgcctcagataaaattccttagtataatccccattttccttaccaaggatggtaggcttagtcactccttgggaggtgccacaggaaaattcagcagatgtcaacagaaaaaaagcctttgctatgaaaagtattcactacctttcatatctcttgaatacttgaaatgtttaattagatgccaccaatagggatccaaggagtgtgggacacggttgcgctgcttttctttataaacgtttattaaaatggctcaacgctgcattcagcttcacctcagctcttcttgtcagccaggagccccgtgtccttggaaactgtagccaaggttacttatttccatactgtgcattgtgtcagcccgcttcaccccactgcttgaatggccattaataagcacttttctttttttggtgggatgttttgcctttaaaatttttatggcttagtgtgtaatttaatttttgtctggacatgcttgagatagaagaggtactggatatatgaggatattttccatgctttatttttcctgtggctactagttagcattccataggggttgtgaatttttaattatttgaatattttgtgtacatatacatatttgaagggttttgggggggtcttatttgtttaaaggtgtcttctgtttgcctatttcaagtgtacttcagctttgcaaagattatagggctgtatgttacagaaataggaaatgctggccctgtactggggaccactacaaaaattccctttagccgggcgtggtggctcacgcctgtaatccccagcactttgggaggccgagccgggtggatcacccgaggtcaggagttcaagaccagcctggccaacatggcgagaccctgtctctactaaaaatacaaaaattagctgggcatggtggcaggtgcctgtaatccgagctactcgggaggctgaggcaggagaattgcttgaaccagagaggcggaggttgcagtgagccgagatcgcgccactgcactccagcctgggcaacaagagcgaaactctgtctcaaaaataaaaaattccctttaacaccttcaaggtcaaatgcctgcctttgtgaacagttaataaactgacattttcagacatttgccattcagaagggagcattgtagcctgctgtagaccattccagcaaatgtcagaatgcagggcaagatgtgtgtcgactatgttttttatgtttaagttacttacttatttcttcaggtaagtgtgtaccaaataacaatactgaaaagccctccccttgccaggccgaggaaataaagcttaagtgaaacagctcttgggggaaaaatgccactttacaaatacttttctaacaaaatagcattataatgaagtttttacttaattccattatttatatgttgacgtgaatgtaagtggttaaaaagtattcatgtgggacatctcattactttgtagctgtggctttattaaccagtgaatgctgtggcccttagcgaaatgcgttgtcttctgcgtgatgtggaattcgcgcctgtattttaaaagatggtgtggtttctcccttgtttgtattttaataaacaactgctctaattgatgtgtttagacattataaagcttcacctttaaaatattttcagggtctgttctgaaatcaccccttgttaaacttctctaaccaaaatacaagtgtagaagaatgtcaggct

SEQ ID NO: 1173 - DNA, 2111 bp, Homo sapiens
ggcggcggctggggagaagcgctctcgtcgcctgcccgaggccggagcggcggggcccgcgcctcctccccccagcgccgcggaggggggaggaggaagatggagacccacatctcatgcctgttcccggagctgctggccatgatcttcggctacctggacgtccgggacaaggggcgcgcggcgcaggtgtgcaccgcctggcgggacgccgcctaccacaagtcggtgtggcggggggtggaggccaagctgcacctgcgccgggccaacccgtcgctgttccccagcctgcaggcccggggcatccgccgggtgcagatcctgagcctccgccgcagcctcagctacgtgatccagggcatggccaacatcgagagcctcaacctcagcggctgctacaacctcaccgacaacgggctgggccacgcgtttgtgcaggagatcggctccctgcgcgctctcaacctgagcctctgcaagcagatcactgacagcagcctgggccgcatagcccagtacctcaagggcctggaggtgctggagctgggaggttgcagcaacatcaccaacactggccttctgctcatcgcctggggtctgcagcgcctcaagagccttaacctccgcagctgccgccacctttcggatgtgggcatcgggcacctggccggcatgacgcgcagcgcggcggagggctgcctgggcctggagcagctcacgctacaggactgccagaagctcacagatctttctctaaagcacatctcccgagggctgacgggcctgaggctcctcaacctcagcttctgtgggggaatctcggacgctggcctcctgcacctgtcgcacatgggcagcctgcgcagcctcaacctgcgctcctgtgacaacatcagtgacacgggcatcatgcatctggccatgggcagcctgcgcctctcggggctggatgtttcgttctgtgacaaggtgggagaccagagtctggcttacatagcccaggggctggatggcctcaagtctctctccctctgctcctgccacatcagtgatgatggcatcaaccgcatggtgcggcagatgcacgggctgcgcacgctcaacattggacagtgtgtgcgcatcacggacaagggcctggagctgatcgctgagcacctgagccaactcaccggcatagacctgtacggctgcacccgaatcaccaagcgcggcctggagcgcatcacgcagctgccgtgcctcaaggtactcaacctgggactctggcagatgacggacagtgagaaggaggcacgaggggatttttctccattattcactgtgagaactcggggaagctccagaaggtgagggagaggggacaacgacatggttcccgtggatctttaacttccagacttgcccgctctgcgcctccggcactctggtgatgacagctcaggtttccctgcctgtcactgctcgggcagaggctgctgcccagggcttctgctccggtaccttgtgaagctgcattctcctgccggtttctccagttctggggacagtggtttgctctgagacctcgcttcctttatggatccaaggagacttgctttttcagtctgttcagctttttacttgctaggatggaattgcaatttgcaagcttcttcgacaggaaactacaagttccacactttaattttatacatataaatatatacatgtgtacatatatctatgtacaggggtattatatatatacatataagatgatgatatatataatgatgatatgtattactgagaacgtaaaatatcattacatagtgatagctggacacacaaggaattcacaactccccaaagaaaatacatctggatgacctgcctagcagtttccccatgagatagaggaatgtctacgtatttcattccctgttcctgccctgaaacaatttcaatcactgacaaatcattatcattcattaataatgtttactgagtgcccatatgtgaaagaaatccactctacattccacagatgcatttcctctccccacggggtttccattttaatgggaacaatgtagaatatatctgtcttccctttatagattcca

SEQ ID NO: 1174 - DNA, 1744 bp, Homo sapiens
ctcttgatttctggggccggtgaccaggcccaacgcagccttcaagtcggcccaaacacggtttctgcctcaaggattatttatataaccattgcttattggctgctggcaaacactcgctcttctcgttggctgaaactgtcgggagaagttctgcgaaggctgctccttgcggcgttgggactgagggtcacaggcacctgtatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaa

SEQ ID NO: 1175 - DNA, 1463 bp, Homo sapiens
ctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtctgttttttcatgctttgctttttaattattattattattttttttacattaggacattttatgtgacaactgccaaaaaagtatttttaagaatttaagcgaaataaacagttactctttggtaaa

SEQ ID NO: 1176 - DNA, 1668 bp, Homo sapiens
agttccgggccgcctgggggcgtggccgggcctgtacagcagcctgggccatgtcggcgccgccggccctgcagatccgggaggcaaacgcacacctggcagccgtgcaccggcgcgcagcggagctggaggcgcggctggacgcggcggagcgcacggtgcacgcccaagccgagcgcctggccctccacgaccagcagctgcgcgccgccctagacgaactgggtcgcgccaaggaccgtgagattgccacactccaggagcagctgatgacctcagaagccactgtccacagcctgcaggccaccgtgcaccagagggacgagctcattaggcagttgcagccccgggctgagctgctgcaggacatctgccgccgccggccacccctggctgggctgctggatgccctggctgaggctgagcgcctggggcccctgccggccagtgaccccggccacccaccccccggtgggcctggtccaccccttgacaacagcactggggaagaggcggacagggaccacctccagcctgcagtgtttgggaccacagtgtgagcccggaatgcagattacagaatggagacagaaagccactgctgtcagtgtccttgggagtcaccagcaccctgcagggggaccctacggcagagccaaagtcctgtctaagcatcagaacaggctgaacagtcaaaaagttttcaaataggcccacaggccaggtgcagacgtttaacccagacagaagtgttcttgtttgtttttaagctttgaatcagtcacccttgctaaaaacctggcaatgcaaacacaaagatctggatttctggcaagacttggccaagcttgcctggagttcagggcaccctctttagccagggtgtgagtttctgttttttgtttttttttttttaagacagagtcccactctgtcgccctggctggggtgcagtggtgcgattttggctaactgcaacctccgcctcccaggttcaagcgattctcctgtctcatccttcagagtagctgggattacaggcgcccaccaccacacccggatattttatatttttggtagagaccggggaggggagggggtttcaccatgttgaccaggctggtctcaaactcctgaccttaggtgatccacccgcctcggccttcgaaagtgctgcagttataggtgtaagccaccgcgcccggccctagcctagcttttgtagcatgcaactgtctcctttttatacgccctaaagaatatatttttgaactccttgtttctgcgctgtccttcttagcccaggacattcagggtgctttgcttgttgtcaaaccagggaaaggagaaaactcctgtgcctttctgggccagcctgtcaccctggcctggtcggcagccattcccctacctcctcactcaggaactgtcacaccaggaaccggcgaggggcacagcctgtttcagaccagaaaggtcggaggccacccacggccttcaggatggcgcccgcctgcctgcctggcaacagtgacccctcagtgcagtaacaatgggcccattttctcctctggatgaacaaggaggggggttgtttgtacaaaggaaaggcaggctggggcctgtctgtgctcaagaataaaccggatgatttcctggcctgggggc

SEQ ID NO: 1177 - DNA, 2951 bp, Homo sapiens
ctttggggttctgtgtgcagcgagcatggtgtccttggcaccagggtttcggcagaggagcctagcgtgggcctacttggactcctccgcgtggggcagctcgggacacccgggcctgcaggagagcggggttctaggctggccccggctctgcagtgcagccgggtgcctgccactcgcggggctctgtcgcagtactcgtgcctggcgcctcccctcagccacagagaccgcagtagctccaaccatcgcacccctaactgggccacgagttctctgattgccagacctgttgtctttgccactcactgttctgagtaattggagagtcgtgtattcactacacgccaaccagagtggtcctgtaaaagcgtaagcctagtgtagatacgcttctgcttaaaactcttgagtggctcccagtgcttttagaacaaaatccaaacgcctttccgaagtcgacaaggcccagcttgattgagcagaagatgtgataggagatgaggagcggggggcttctgcaaaagtgcttcggtcgctcaggcttttggcacattttgcttatgcaacctagttctttctaccttagggccttttcttgggaaagttgggagtctcactctgctgcctaggctgagtgcagtggtgtgatcgaggcgcactgcagccttgacctcctgggctcaagcgatcctcacctcggcctaccgagtagctgggactacaggcacgcgccactacactcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcagtggcgggaccactggatgcagtgtgtgtacttcctgccacaagaggagcctgtggtgcagggctcagcgctctatctggtagcccaccacgatgactactgcgtatggtacagcctgcagaggaccagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtgctgaagccagacagcgtgtgcctgtgtgtcagcgatggcagcctgctctccgtgctggcccatcacctgggggtggagcaggtgtttacagtcgagagttcagcagcttctcacaaactgttgagaaaaatcttcaaggctaaccacttggaagataaaattaacatcatagagaaacggccggaattattaacaaatgaggacctacagggcagaaaggtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggacctgtggcggatccggagcccctgtggtgactgcgaaggcttcgacgtgcacatcatggacgacatgattaagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcaccgtggagctcagaaggcccgggcagagccacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctggggttctga

SEQ ID NO: 1178 - DNA, 1450 bp, Homo sapiens
ttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagtgtgtgaggggggagagcttgagtttctggcctcattgcctatttgtaaagctgtagcctaaagggctctcccaatgcagcctggtctgaaactgctttaagaagcctctgaccctcttcagggccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggtaagtgcctgcagtggtgactttggcttctttccctagagcctagtgggataggaaatggagggaagattgcatttagatcatatcccatgggctttcaagccttaaatctagggaaatccagaaaggaaagagaagagggaacatttcttaaattgggcttacctcccctcttagaaaagttagagcagccatgcacccagggtgtttctcaatatctaaggcagcggcctcaggacacaatgaaataatgcattctgaggatccctaacagaagttatgagattgtcttatgctctttggtttgacagtgcctagtaattaagagggggctctgggctttgctgtactattatggatttctctttaacttcagttggagaaattctgagatcagtccccacatggatgagaaaataggcccccagggagtttggactccaagcccagtgttctttccctataagataacccatgggcaaacttggtgacccctgtttctctagtctggattattcctctatgggtttttatagacataggaac

SEQ ID NO: 1179 - DNA, 506 bp, Homo sapiens
cggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagtgccccatcatctctacccccagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattc

SEQ ID NO: 1180 - DNA, 2470 bp, Homo sapiens
gtccactgggcttggagtcagtggcaataaccaggggcaataaccaggcgtgtcccaggggggagccccgctctgcagccctgtgcgccgtagagagctggacttaggctggcagcatggccgagttcagggtcagggtgtccaccggagaagccttcggggctggcacatgggacaaagtgtctgtcagcatcgtggggacccggggagagagccccccactgcccctggacaatctcggcaaggagttcactgcgggcgctgaggaggacttccaggtgacgctcccggaggacgtaggccgagtgctgctgctgcgcgtgcacaaggcgcccccagtgctgcccctgctggggcccctggccccggatgcctggttctgccgctggttccagctgacaccgccgcggggcggccacctcctcttcccctgctaccagtggctggagggggcggggaccctggtgctgcaggagggtacagccaaggtgtcctgggcagaccaccaccctgtgctccagcaacagcgccaggaggagcttcaggcccggcaggagatgtaccagtggaaggcttacaacccaggttggcctcactgcctggatgaaaagacagtggaagacttggagctcaatatcaaatactccacagccaagaatgccaacttttatctacaggctggctctgcttttgcagagatgaaaatcaaggggttgctggaccgcaaggggctctggaggagtctgaatgagatgaaaaggatcttcaacttccggaggaccccagcagctgagcacgcatttgagcactggcaggaggacgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccagggcctggtgctgccctacacctacctagaccctcccctcatcgagaacagcgtctccatctaaatcccaggggaacacaggcccagatgacatccctttgaccacatcgctctaggataactggcacccagagaaaaggactcctcagaaaaaacaggcccccatgtgcctctcctgggacaaccagactctgtaactcacccccaccaccatacacacacacaaaaacagaaacaaaatcaaaacagagaaagcagaaaatctaccaagaacagagtctcaggacagaaccactgagtcttttggaggctccaagcctcaaagtgcccgcagagcccaccttgagggttttgctagttggttttgttttgcgttttacagccgtggggggaagcacataatcccgccccagggcccactagcatccactgattggaccttatggtcacccaactcaaggacagccaccaagaagtggctgccaaagagactgggcgcagtggctcatgcccataatcccagcactttgggagatggaggcgggaaaatcatttgaggtcagaagttcaaggccagcctggacgacatagcgagactccacctctacc

SEQ ID NO: 1181 - DNA, 3422 bp, Homo sapiens
cagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaa

SEQ ID NO: 1182 - DNA, 7775 bp, Homo sapiens
agaggggaaaagaacgtcaggagagtgaacgggagcaaataaaacgctgtccattctgactggaagggccagagccgtgtctaagggcgggggccgggaggtggcccgcggtggtgtctctaccaggacgaggcctggggtatctgaagaggggatgacgtccaggcgctttgctaaagggaagccagaagggtatgagttgctagggtcagagatggggctttcggctcgagtctttccctgcagggcagagagtccgaagagcccgagaaggcagggaggacagtgggcctggtccttccccggccggcagagggagtcccgagatggaacgtccagctctcctctaacgaaaagcgtttgcatggctgtctcgccaattctgtacctcccggggctgaggaagagccgaggtgactagaagctagcgacaagtgccggccacctccgacgccaggcgccgggcttggagcccgacgggccgaattctcgcgagagcggccgccgccatttttccattgattgcagcgggctgggggaggggccgacgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagaggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgggggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatattccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggttcattctgggagcgctgctggtggtcattattatgcatgtataaagtcattcagtgatgagcagtggtacagcttcaatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtggatgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaggatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctgttgtgttattttagtcattaaacttctgtggatgaagaatctgggttaagaatagatttgtcatctttaaatatgacattttgtaatgtgtattggatatctcatttctatgataaaggtatatttacagtaaagttctcataagagaaatgaaaagctgtgttaatatctaactttggggaaccctgtcagtatttcagatccgatttttaccctttttttcttataagaaagataaaattagaaaatactgttagcaaatgtggctctgccatttgaatataatcaccgagaattccatgtcttaaaagtctcctggaatccacaatgaaaaaaaaaatcttttctaaggtatttttctggctaatttttatttgaagaaagctatagcatttagcgaaatttgactgaagtaatgttctgagtttgcattagtgggattggtgatgttctcagaagaaaattggaaacacttgtgatgaattgtctttcagatcacttagattttctgatgtaagaggacagctgtttggttctgatacaggcctgcttacttgggatgtagggttagtaaatggggtttctgctttaaaggactgacttgctatcacacaaaagaggcagacttgtaaacacaatgggctttggagtttggtctgattgggtttggtttagtattcctatgagcgtaaatggtaaaattcttctgatacccactctttagactgtgccttctgctctgttctttgttttatgtttaactgctgtttctaattgcaggtgtattacagatacaaataagagtaaagaaaatatatttcattatagaaaagaaaaaattaaaagcttcttgcttttcagtgcctgatagagtgaaaacacaaagttgcactttaataatttcaataaaagctaatctgtgtcagcctccctctgcttcagagagtcaggtgagcatccataacctaacaggcagagccctagcgatgtggatcaagtttcctgagcccgggggcggtggagcctcatgatctcttatcttttgaggctgaggcaggtcacatgcaacaaattgtgaccctgctccccacaagtcatgcaaaggttttgaagagcttttaccgtggggcagatgaacttgtgtcaaccatgcacaccctgtgagaaccaagtacctgtgtttctaaggcgggcactcaaggtgaggggtgcattctggccaaagaaacaaaagctgtggtttcaggaccatgccgtgtgtagctgatctgtacgggacgtgtatgtaaggaagagcaatcatgatagataagaacagtgtgtgaagcagccttcacactagagtgtttggtcatctcttataatgtaagggaaggtactttaaaattctgggaagatgcgatgaactcatgtcccagtcagaaaataatccaatgaaataagcattggttgccaggccacagttaggaattgtattgtgatacatctagaggccaagagagcaggagagagctaccaacttacactgtggtttaagctaaatgaccgcacagcatcatagcattgcagtgttgttactaaatctggaagtgacctgtgaatgtatggaatacaataaagtcttttattctggttcatttgctagtacttcctttttgattggatactgtagttcttcctctggattttattttgttcagcgtcaaggccctaattttgcaaatgtagtctaaaccacattacgtggactagaggatactctgaattagcaagttttttgtttgctgaataaaactattccatctt

SEQ ID NO: 1183 - DNA, 1014 bp, Homo sapiens
gttttcaccatgttggccaggctggtctggaaccccgacttcaggtgatccacgttggcctcccaaagtgttgggattacaggtgtgaaccactgcgcctggccatgaagtgtccaataaatattagattgacataaagaaccctcaggtgtgctatctcatggaataccctcaaattcctctctggatcttcctatcacagttgtattattggggtcccatttggatctctcccactataggtagctcttcagtgggacgggctaggtaagagaggctgggagtaagtctgtctgatctaggatgtcttgcttaccacccaggtagggggttatatactcccagcctttctgattccattgtaactcttgccgaaatccgggtgaacggaagtagtctctttaagaactggtatgggcaggcccaagttgtcaaggcttcggaggtaatgccctggagagcggggaacggggtgggtttagaggcccaggcgggcacccaggaggcaggcccagaagagtactgccaggaagagttgggcgccgaggaggagatggcagccagagcagcatggcctgtgctgcgctctgtgaactcacgcgagctctcccggatcatcatctgcaatcacagcccacgaatcgtgctgcctgtgtggctcaactactatggcaagctgctgccctacctgacgctgctgcccggcagggacttccgcatccacaacttccgaagccacccttggctcttcagagatgcaaggacacatgataagcttctggttaaccaaactgaattgtttgtgccatcttccaatgttaatggacagcctgtttttgccaacatcacactgcagtgtataccctgaaagagcaatgcctccaggttgtcggaagcctagtcaagcccaagaattacaggagactggacatcgtcagatcactctatgacgatctggaagatcatccaaatgtgattgaaagacctggagcggctgacgcaggagcacagtga

SEQ ID NO: 1184 - DNA, 713 bp, Homo sapiens
atggaggggtgtgtgtctaacctaatggtctgcaacctggcctacagcgggaagctggaagagttgaaggagagtattctggccgataaatccctggctactagaactgaccaggcaggttggtctcctcttcatattgcggcttctgctggccgggatgagattgtaaaagcccttctgggaaaaggtgctcaagtgaatgctgtcaatcaaaatggctgtactcccttacattatgcagcttcgaaaaacaggcatgagatcgctgtcatgttactggaaggcggggctaatccagatgctaaggaccattatgaggctacagcaatgcaccgggcagcagccaagggtaacttgaagatgattcatatccttctgtactacaaagcatccacaaacatccaagacactgagggtaacactcctctacacttagcctgtgatgaggagagagtggaagaagcaaaactgctggtgtcccaaggagcaagtatttacattgagaataaagaagaaaagacacccctgcaagtggccaaaggtggcctgggtttaatactcaagagaatggtggaaggttaaacagcttggatttattcttactttgtatgttgtgttgttgtccccagtgtcctacaaactaatgtatttgtgcacaagacatcatctatgaatgatgaagttttctcaccttcaaagtcttataaacatgt

SEQ ID NO: 1185 - DNA, 1259 bp, Homo sapiens
ggacagcttggagatagggcccggaattgcgggcgtcactctgctcctgcgacctagccaggcgtgagggagtgacagcagcgcattcgcgggacgagagcgatgagtgagaacgccgcaccaggtctgatctcagagctgaagctggctgtgccctggggccacatcgcagccaaagcctggggctccctgcagggccctccagttctctgcctgcacggctggctggacaatgccagctccttcgacagactcatccctcttctcccgcaagacttttattacgttgccatggatttcggaggtcatgggctctcgtcccattacagcccaggtgtcccatattacctccagacttttgtgagtgagatccgaagagttgtggcagccttgaaatggaatcgattctccattctgggccacagcttcggtggcgtcgtgggcggaatgtttttctgtaccttccccgagatggtggataaacttatcttgctggacacgccgctctttctcctggaatcagatgaaatggagaacttgctgacctacaagcggagagccatagagcacgtgctgcaggtagaggcctcccaggagccctcgcacgtgttcagcctgaagcagctgctgcagaggcagagaacagcattgacttcatcagcagggagctgtgtgcgcattccatcaggaagctgcaggcccatgtcctgttgatcaaagcagtccacggatattttgattcaagacagaattactctgagaaggagtccctgtcgttcatgatagacacgatgaaatccaccctcaaagagcagttccagtttgtggaagtcccaggcaatcactgtgtccacatgagcgaaccccagcacgtggccagtatcatcagctccttcttacagtgcacacacatgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagggggagacagagtctgggttccagggctgctttctcctggctaataataaatatccagccagctggaggaaggaagggcaggctgggcccacctagcctttccctgctgcccaactggatggaaaataaaaggttcttgtattctca

SEQ ID NO: 1186 - DNA, 1648 bp, Homo sapiens
gacacactgcacagcgaccactgagcatgcctgcaggctccatgtctactacaggctatcctggtgtctgcagtaccacatcatacagaactcactgttatatcccagtgacctcttctgttactcttagctccagtgatttaagccctacctttggacactgcttacccagtagctaccaaggaaatctctggctcctggattactgccaagaatcctacggtgaagcaccaacctgcaaatctcccagctgtgagcccaagacctgcagtaccactggttgtgacccgtcaaactcctctgtgccctgcaactccccatcagcaggccaagtcttcagtgtctgtgaaactaccaacgtcagccccagccccagctgcagcccaagcacccagaccaatgggtatgtatgcaattgccacatacccactcgaaatgcatccaaagcctgccaaaccctccgcaacggttccaactgctttggacaacttaactgcttatccaagagtttccaaactctaaaccactgcagattgagtactttggggtataaaagctaccaaaatccttgcttcatacccagctacgtctcaccattatgttatatttccaacagctgccaaccccaaagctatttagtgagaaattatcactattcaagctacaggcctacgagctgccgaccactgagctatttatctagaagcttcagatctctgagctatatacccagtacctttccacctctgaggtatttgtgcagtggtagcagacctctgaaatgctattgaccaacttccagaatttatagcagctggaaattgcccaatggggaagattctactaagtactagaacgtctaattttctgctgaatctctttattcagcctaagaatcttgttacattaagttcaaatacaactcccaggtttattaaccacagccagtatcacctgctaggttttcttttttctgttgttctgttattgctctttgtactaaaagctgaccctgaaggtaacatcattatttctgagatttattacaatggacttaccgaagagactccatttgaaatacaaccatcaccggctttcttactttggctgtcactgtcacttgtctgacagtgtgattatcacctacctttcctgatgaaatggggcctccatggtttgactgcagattccagcatgcaaattcattcggatggctttgattgtcattaatatttttgtcaactacctaactagcaccttgctaataagccgatagaaaacactatcttgagcataataagttgaactatttcatccttttcttactgattgattgtaagaacaggcaaatagcaatggtgactagagctcaaaaatagaagacttcagcaaatcttctcttccagagaagccataaaacaagattcactggtactcagcttttgttctccatgcctaagaaaaagcctcagaattagctaaagcatgaaaattatttgttgaaagaagaacaaatactgttagagaccctttacaattatgtgtaatctgcgtttaggattctcctatcatcttgccttgccaatttattgcattctgactctggaaaatgtcctagttcttagttaataaacaaatttctgtctgg

SEQ ID NO: 1187 - DNA, 1637 bp, Homo sapiens
gttctggcagcccattccgagactagcggaggcgggcagggagggtatataagcgttggcggagcgtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtg

SEQ ID NO: 1188 - DNA, 1432 bp, Homo sapiens
ttcccagtgttctggcaggtaaggaacgccggctcttcgcctctcagcgcggcttgtcctttgttccggacgcccgctcctcagccctgcggctcctggggtcgctgctgcatcccgcacgcctccaccggctgcagacccatggccgagcgcggggaactcgacttgaccggcgccaaacagaacacaggagtgtggctagtcaaggttcctaaatatttgtcacagcaatgggctaaagcctctggaagaggtgaagttgggaaactgcggattgccaagactcaaggaaggactgaggtgtcatttactttgaatgaggatcttgcaaatattcatgatattggtggaaaaccagcttcagtcagtgctcctagagaacatccatttgtcttgcaaagtgttggaggacagacattaacagtatttactgagagctcatcagataagctgtcattggaaggaatagtggtacaaagagctgaatgccgaccagctgccagtgaaaactacatgcgattaaaaagattgcaaatagaagagtcttccaaaccagtgaggctatcacaacagctggacaaagttgtaacaaccaattacaaacctgttgctaatcatcaatacaatatcgaatatgaaaggaaaaagaaagaagacggaaagcgagctcgagctgataaacaacatgttttagacatgctattttcagcctttgagaaacatcaatactataatcttaaggacttggtggacatcacaaagcaacctgtggtgtacctgaaggaaatcttaaaagaaattggtgttcagaatgtaaaagggatccacaaaaacacatgggagctgaagccagagtacagacactatcaaggagaagaaaagagtgactaagaagactcctagccagcatgctagtgaaacgactagcagcgatgctatgcaaaaggcgctgatactggaaggcttgaacaccgtatgttaataggggttaagtgacagtactttgatttctctcggtaaattttttaaacctgtaattcttgtaaagtttcttaactgtttttttgaggagaaagaacagatttatttatagacttaacttgtattaaaccagattattcacagtaggaataggggttggaggattaagagggtttttcttaaatattagcttttaatgtgtacaattaggaaatttttttaagtgaggactctctacccttgccgtatctaaggagctgaggtaatacagatccaaggagaattgtatagcaagaaaaaaacagtcaactacagaaactcttaaaaggaataaaaacccaaagttccttattttgaaattgtcaaagaacaaagcggtgtttttcttttaaacaggtgatcacgtttcgtgttcatactcaacgttaataaaaggagagagtttgtagtg

SEQ ID NO: 1189 - DNA, 6997 bp, Homo sapiens
atagtaggcaatatttatgtgtcatttattattattgctattagtgttacctattattttctttttgaacccacttattgcctaattagtcatagtttgacaattgcccttgtattccaccatgtcaaatataaatttacatagatgaagctcctgaaattattcttgggttaccattttgtgaagctattgatatgtggtcactgggctgtgtgatagctgagctgttcctgggatggcctctttatcctggtgcttcagaatatgatcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactgcaggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggtactggggatggggacattcctgcccataaaggatttggggaaagaagattaatcctaaaatacaggtgtgttccatctgaattgaaaatgatatatttgagatataattttaggactggttctgtgtagatagagatggtgtcaaggaggtgcaggatggagatgggagatttcatggagcctggtcagccagctctgtaccaggttgaacaccgaggagctgtcaaagtatttggagtttcttcattgtaaggagtaagggcttccaagatggggcaggtagtccgtacagcctaccaggaacatgttgtgttttctttattttttaaaatcattatattgagttgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgtttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcataaaaatccacctgtgtctgctgaatgtgtatgtatgtgctcactgtggctttagattctgtccctggggttagccctgttggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgattttttttttttttaactgatagatggtgcagcatgtctacatggttgtttgttgctaaactttatataatgtgtggtttcaattcagcttgaaaaataatctcactacatgtagcagtacattatatgtacattatatgtaatgttagtatttctgctttgaatccttgatattgcaatggaattcctactttattaaatgtatttgatatgctagttattgtgtgcgatttaaactttttttgctttctccctttttttggttgtgcgctttcttttacaacaagcctctagaaacagatagtttctgagaattactgagctatgtttgtaatgcagatgtacttagggagtatgtaaaataatcattttaacaaaagaaatagatatttaaaatttaatactaactatgggaaaagggtccattgtgtaaaacatagtttatctttggattcaatgtttgtctttggttttacaaagtagcttgtattttcagtattttctacataatatggtaaaatgtagagcaattgcaatgcatcaataaaatgggtaaattttctgactta

SEQ ID NO: 1190 - DNA, 3605 bp, Homo sapiens
tcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaagacagggtcttgctccgtcacccaggctggagtgcagtggcgtgatcatggctcacttcagtgtccaactcctgggctcaagcaatcctcctgccttagccttccaaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttccctccctga

SEQ ID NO: 1191 - DNA, 2789 bp, Homo sapiens
gggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctcctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagagccccccccggggccgcaggagagggcccgggctgcgcggatgatgagggcccagtgaggcgccaagggaaggtcaccatcaagtatgaccccaaggagctacggaagcacctcaacctagaggagtggatcctggagcagctcacgcgcctctacgactgccaggaagaggagatctcagaactagagattgacgtggatgagctcctggacatggagagtgacgatgcctgggcttccagggtcaaggagctgctggttgactgttacaaacccacagaggccttcatctctggcctgctggacaagatccgggccatgcagaagctgagcacaccccagaagaagtgagggtccccgacccaggcgaacggtggctcccataggacaatcgctaccccccgacctcgtagcaacagcaataccgggggaccctgcggccaggcctggttccatgagcagggctcctcgtgcccctggcccaggggtctcttcccctgccccctcagttttccacttttggatttttttattgttattaaactgatgggactttgtgtttttatattgactctgcggcacgggccctttaataaagcgaggtagggtacgcctttggtgcagctcaaaaaaaaaaaaaaaaatgatttccagcggtccacattagagttgaaattttctggtgggagaatctataccttgttcctttataggccaaggaccgcagtccttcagtaacaccagtgtaaaagcttgaggagaaattgtgaagctacacagtatttgttttctaatacctcttgtcattctaaatatctttaatttattaaaaaatatatatatacagta

SEQ ID NO: 1192 - DNA, 2188 bp, Homo sapiens
agaggcaggtgagcgcgatgcagccggcgccgggtctggggctcggggactcctccctgcaccgctacctggacggcgacttctggagcctcaagaacgagctgcgcggactcctcggcggcgcccgctcttccggcaaaggtatgatttaagcttggatgaaatgagagctttgacagttcagagagtgaagtttgccatggacctgcctctgttaaaacgtgcaggtcaggatctggcagagaaaacaaagaattttgtcagccgaagccttgtcataggagaagtcctctccatggcggacatggccacaggagtgaagtgcggaataatttattggctatttggtggtgctatcaggaatctcggaagccctgaacatgttactaagtggtttcagccactccaggagcagaaatacactgggatgtttgcaatgaccgagaggggccatgggagcaacgcgagagggatccagaccgaagccacctttgacctctctgcccaggagtttgtaattgacacgccgtgtgaaaatgcggagaagatgtatattggaaatgccatgtacgggaattatgcagctgtctttgcccagctcatcatagatggaagatctcaagggccccactgtttcatcgttcctgtccgggatgaaaacggaagcttgtacccaggagtcacagctattgatatgatgtacaaggagggtctgcatggtgtggacaatgggatattaatatttgacaaggttcggatacccagggagaacctgctggataagtttggttccgtggctccagatggacagtaccattcgcctattaggaacaagagtgcaagattcaatgccatgctggcagcactgaccccttcgagattagctgtggctttccaagctatgggtgccatgaagcttgggttgacgatagccattcgctatagccacaggtccagaatcatctcccagaactgctgttcagctccagctggtctttattgagcccctcttgtggaccaggctaatttcctgaaaactggtttttgctaacgtttcttacgcttgctcgtgaaatcagccacttaactgttctgggttttcccgtggcagatccctataggcttctcactgcactatcccaaactttttatctgagaatgttgtgtggcaagatgtctgcagagtgccgcttaggagatgctggcctggcgtccacgggtctgctgtgtatgtctctccaggcagatggcctgtctctgcctggcaaggacgatctggggtggaaaaactctgatctgaaagtgaaatcattgactccgttaccatgttctgaattcccagatctccctgatatggaaagtgaaaattggcttctattacacaatgcatcaaaattcttttgtataggaccagaccactgatatcaagggcagtgcactgactttcagttcctctgcatcccttggtcatgttcccacctttcaatgggaacagagaataaaaattccagctctagggcccagcctagtggccacctctcacggacaggcacccggctgctcagtgttatccaattactagaggccattcctagcatttcaacttggggaattaatttactattactttatttttatctttagagacagagtcttgctctgtcacccagactagagtgtagtggcatgatcatagctcactgcagccttgaactcctgagctcaggcaatcctcctgccacagccacctgagtagctggaactataggcatgtgccatcatgcccaactaattttatttttatttcagttgtagagatggagccttaccctgttgcccaggctggtctctgactcctggtctctagtgatcctcctgccttggcctcccaaagtgctaggattataggtgtgagccaacatgctgtccccattattgactgttaccctaaagtgtgtgttgcctttctagtttgagtagaaagtccagcattatctttttggataatatccaggttttgctgtttctttctttatttttcataatgagaacatttgctctcttgctgacattggagggcgtctgtttacctctcctgtaggcacacaaaattcccaacgtttatttgaagaaaaagacaattatttgagtaatttgaataaataaacattttaagtgattcccaaaa

SEQ ID NO: 1193 - DNA, 2761 bp, Homo sapiens
cttcccatagccgcggcctcaactaaaagtggccattgacctttcaagctttcgagcagtgatgcaatagaatagtatttcaaagaaaaatgcttatcgaaattttggatccggttttcccgtgattgttaagggtttcttttaaaaagtaggtcacatttcaagtaggtcatatttcgggggcgggtgcgcagacaaggagatgagtttccactaaggccagggggcctccaacggggttggaggtgagaatcccaggtagggtagaggtgccgagatccttccgaatcccagccctggggcgtcagccctgcagggaatggcagagacactctccggactgagggaaccgaggccagtcaccaagccccttccgggcgcgcaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactgga

SEQ ID NO: 1194 - DNA, 1765 bp, Homo sapiens
aaagtggcgagagccacctcggcgcttgggcgctcagtcgcaggaggcgctccttggcggtgcctggagcccgggcgcaccccaccgctcccgggacctgttgggggctggcccgaaccgtcgtcgaagggagccgctcggccacccccgacgttcctcgccccgcccgacgttccctcaagtggccgaaccagccggacgagccaaactcgccgggcctcccggcggcagcaggtggccccgtccttccagggagggccctgcgccccgcggcgctccggagccctctcggccgcccccgccaggcgggatggaggcggatggggacggagaggagctggcccggctgcgctcagtcttcgccgcctgcgacgcgaaccgctcggggcgcctggagcgcgaggagttccgggcactgtgcacggagctgcgggtgcggccggccgacgccgaggcagtattccagcggctggacgccgaccgtgacggcgccatcaccttccaggagttcgcgcgtggcttcctcgggtccctccgcggggggcggcgccgggactggggtcctctggatcccgcgcccgccgtgtctgaggcggggccggagacacacgacagcgaggaggacgaaggcgacgaggacgcggcggcggcgctggccacctcgtgcggcccggcgagtcccggccgggcttggcaggatttccaggcgcgacttggggacgaagccaagttcattcccagatttggctacacaatttcaaaacctgcatttgtgttcgtgaggcatctcataacactgtgtgcattgtcatgggctaaaaaggaaggcagagaaacactttggacaatcgaggagggaggagccaagatggccgaataggaacagctccggtctacagctcccagcgtgagcgacgcagaagacgggtgatttctgcatttccatctgaggtaccgggttcatctcactacggagtgcgagacagtgggcgcaggccagtgtgtgcgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacaagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagcctggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagatggagatctgagaacgggcagactgcctcctcaagtgggtccctgacccctgacccccaagcagcctaactgggaggcaccccccaacaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatgggg

SEQ ID NO: 1195 - DNA, 986 bp, Homo sapiens
gcccttgacgtagcagtaaaaaccttcccccctgagagacacgtggcagtgaagtgttttggaaaaaaaaaggaaaaaaaaaacaatgccaacagcccagcgtccgtgagcaacccaacagtaacaaagcatgcgttcgggatggaggaagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcatgggaagagtttgtctttcttatctttaagcccctttaccctggtcctgtactgatcagtgaaggaaaccgtggttactgaggccctgttgaaaagtgcacgtcttgtccaataaat

SEQ ID NO: 1196 - DNA, 1701 bp, Homo sapiens
cgggagcagcggccgcaggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttacc

SEQ ID NO: 1197 - DNA, 4211 bp, Homo sapiens
gactgggagcaggcagcccgggcggagcgggccggtgccgaggacggccccaggcattgctctgccccgggcattgcgcggcgcgcgtgagggggatgcggcaggaggcggcgcggcgggaggagtaggcggcggcgccctcgggagggagctgcgcgcgggccagacggcgcccggaggctccgcagtgccgccgccgtcgcccgggaggctccgcgcgggagccatgtaaccctgcggcgggctccgggctgctccgtccttccccagctcccgggctagcgcggcagcggggccacgatgaagaagcagttcaatcgcatgcgccagctggccaaccagacggtgggcagggctgaaaagacagaagttttgagtgaagaccttcttcaggtggagaagcgtctggagctggtgaaacaggtgtcccacagcacgcacaagaagctcaccgcatgtctgcagggccagcaaggggcagaggctgacaagcgctccaaaaagttgcctttgacaacactggctcagtgtctgatggaggggtcagctatcctgggagatgacacacttcttgggaagatgctgaaactctgtggagagacggaggacaagctggctcaggagctgatacattttgagttgcaagtagagagagacgtgattgagcccctgtttttgctggcggaggtggaaatcccaaatattcaaaagcagaggaaacacttagccaagttggtgctggacatggattcctcacgaaccaggtggcagcagacttccaagtcttcaggtttgtccagcagcttacagcctgcgggtgccaaggctgatgccctcagggaagaaatggaagaggctgccaacagagtggagatttgcagggaccagctctcagctgatatgtacagttttgtggccaaagaaattgactatgcaaactactttcaaacgctaatagaagtgcaagctgaataccacaggaagtccctgacactattgcaggctgtattgcctcagatcaaagcacaacaggaggcctgggtagagaagccttccttcgggaagccgctggaggagcacctcaccatcagcggccgggagatcgccttccccatcgaggcgtgtgtgaccatgctgcttgagtgtgggatgcaggaggagggactcttccgagtagccccctctgcctccaaactgaagaagctgaaagcggccctggactgctgcgtggtggatgtgcaggagtactcggcagacccccacgcaattgcaggagctttgaaatcttacctccgagagttgccagaacctcttatgacctttgaactctatgatgagtggatccaggcttccaatgtccaggagcaagacaagaagcttcaggctctatggaatgcttgtgaaaagttgcccaaggccaatcacaacaacatccgatacttgataaaatttttatccaagctgtcagaatatcaagatgtaaacaagatgactcccagtaatatggcaattgttttaggacccaacctcctatggccacaagcagaagggaacattacagagatgatgaccacagtgtcgctgcaaattgttgggatcattgaacctatcatccagcatgcagactggttcttccctggggagatagagttcaacattactggcaattatgggagtccagtacacgtgaaccataatgccaactacagctcaatgccctccccagacatggaccctgctgaccggcgccagcccgagcaggcccgccggcccctcagcgtcgccacggataatatgatgctggagttttacaaaaaggatggcatgggtgtgagggtcatggacacaaactgggtggctcgaagaggctcctcggccggtcggaaagtgtcctgcgccccgccctccatgcagcctcccgccccgcccgccgagctggctgcgcccctgccttcgccgctgccggagcagcccctggacagccccgcggcccccgcgctctctccatccggcctgggcctccagcctgggcccgagcgcaccagcacaacaaaaagcaaggaactttctccaggctctgcacagaaaggaagtccaggctccagccagggcacagcctgtgcagggactcaaccaggggctcaacctggagctcagccgggcgccagccccagccccagccagccgcctgcagaccagagtcctcacaccctccggaaagtttcaaagaagctggcaccgattccacccaaggtcccctttggccagccgggggctatggcagaccagtccgctggccagccgtccccagtcagcctgtcccccaccccgcccagcaccccgtcaccctatggactgagctaccctcaggggtactccttggcctcgggccagctctccccagctgcagctcctcccctggcctctccttctgtctttacaagcactttgagcaaatcgcggcccactcctaagccgcgacagagacctactctgccgcctcctcagcctcccacagtaaacctctcggcctctagtccacagtccacggaggcccccatgctagatggcatgtcccctggggaaagcatgtctacagatcttgtccactttgatattccctcgatccacatagagctcgggtcgacgctccgcctgagtcccctggagcacatgcggcgacactcagtaactgacaagagggactcggaggaggagtctgagagcaccgccctctgacatgacaccgcccatcctgcctcgcgtgtacatacatcacgggccctaggaacgccgccaggagcagcgtccatgagcttgccaagtgttctctgctggctctttcctgccactgccaacacgaggttggaatttggcagaaaattgtgatctccagtccgtgtggtgatgctggtggtgcaggttttgtttgttcctttcgggtggtgacttcggccttttgtttgacctttgccttttgactttgtgcctcttttgatccactttcagcctccatgccagaaaacacccacctctccatccaaggctggtcaggaacgtcctttgcagggtcggggtggtgcgggagaggctcactttgcctggttagacccaagggctgctaccttttccttggacggctcatgtcaggtcttgcaggatcagtttaatggccacagaaaggaagcaggacagcagggcccctctcacccacaactggaccaggtccaggattctagcagtcctggggcactgacctttgccagctacctgggggagggcttgccactggaaaacctttcaggccgcccccatcagtgggctccaaagtaaatggctgaaaacaaaaatgtttcacttcctaacagttttcctttttccactgtgtgactgaaagctcctatatcattttatatttctgaatctataaaacaaaacaaacaagcctgacagtgtctggaggagccaaaggtggcctccctgtccccaaatatattggctatatgagagtaattttacccctctacgtacctaaaggcacccagttcactagtctgtggggtcctggagcctgtctcttctttctggaggttcaaactgaatagcaataattacgttacccaaagcatgtggaggaaaagtgaaaccagccacggagacgctggcccacgggctcggcctgcggtgtggcctgctttgctcaccagcgtcagccgctcatttccttctcatgaagtcccatctggtcatggggacgagggccgggagggcaccgggtagccttttcacacttggggattaggggagtgagaaaagatttgggccatgcatgcaaagtcaaagtttaaaattttatccttttcaaatagatgatataatatacctatacatgatataatatttgtatatatgaaatctctctatatttgtttaatttgagccattcaatctaaaccaatgtacaggtgtacaatgaaaaatttaaatgcttagttatttttcccaacacagtgtaaagtcaccctcctctgagagtgggatgtgcagagttttgatgttgcagctttgctcacttcctggcaagggcaggtcatgcctcaatttgtaatgggagtctggggtaagggtgggggttgaaagttgttatctttaaatacatgtacaaatcgttgtcaaaagtaacgttattaaaatagatttattatccctga

SEQ ID NO: 1198 - DNA, 1842 bp, Homo sapiens
cccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcat

SEQ ID NO: 1199 - DNA, 3516 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccaggtggagttttgctcttgtcgcccaggctggagtgcagtggcgtgatctcggctcactgcaacctccacctcccaggttcaagcgattttcccacttcagcctcccgataagctgagattacagagtttattaaccacttaacctctcagaactgaacaaagacaacattgttcctggaacgccctctttttaaaaaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaaactttgtaatgcttgtgattccatctgggcaaaagtctgaagatctgaaataactttatatcaaaccattgatcaataaacagctactaatg

SEQ ID NO: 1200 - DNA, 8259 bp, Homo sapiens
tcccaaagtgctgggattacaggcgcgagtggccgctggggttcttaacttgggtctttgaatcgccttaagaagtgtctctgaatctgggaattgcaagcaacgtttctgtgaggaccttcacacagttcatccactcttcgaagagtatggaccgaaaaaggcatagagcattcactgcacgtagagaaaatcagcaacccctgctccccaccctcagcctgaggtgcctacctccacgtggggtcaggaggcggaagcgaaaccagaagaaaaaaccctgagatctataaggcagttcaggtccctagtgacatgagctaaagagaacttggacgccaggactgtagcagacagagtccggcttcggggttcgcatcagtcgcacggaaggtggaaatagcccccaagttgtaacccgccgcggtcttccctcaacagcgcaggcgccaggactgctaggacgccgcgcacctcccgcgatgccccgccccggcgcgaggcaagacgggaaagtcaagatggacgcgtccatttgaacgtctcgcacgccttcctgccattagcactcgagcccgctgctgttgcccgttcttcctccagaataggggagggagagggaatgagaagctgctgcggcccaagagtcactgtgaaggaccccgccgctgccctcgggcctcctcggcccctgcgcctccggggagcagccggggctcgccgcgcctgacgcgtcccgagttatacagaaataatgttgatatttggaacccatgtcgaacttctatgaagaaaggacaacgatgattgcagcaagggatttgcaggaatttgttccttttggtcgagaccactgcaagcaccaccctaatgctttgaaccttcaacttcgccagctgcagccagcttctgaattatggtcttctgatggtgctgctggcttggtgggatcccttcaggaggttacaatccacgagaaacagaaggaaagctggcagttaaggaaaggagtaagtgaaattggagaagatgtggactatgatgaggaactctatgttgctggaaatatggtgatatggagcaaaggaagtaaaagccaggcattggcagtttataaagcatttacagttgacagtcctgttcagcaggcattgtggtgtgacttcattatatcacaggataagtctgaaaaggcctacagtagcaatgaagtagaaaaatgcatatgtatattgcaaagctcatgtattaacatgcatagcatagaaggaaaggattacatagcttcattaccatttcaggttgcaaatgtttggcccactaaatatggattgctgtttgaacgaagcgcttcttcacatgaagtacctccaggttcacccagagaacctttacctactatgttcagcatgctgcacccactagatgaaataactccacttgtttgtaaatctggaagtctttttggttcatcacgggtgcaatatgttgtagatcatgcaatgaaaattgttttcctcaatactgacccctctattgtaatgacttatgatgctgttcaaaatgtgcattctgtgtggactctccggagagtcaaatcagaggaagagaatgttgttttaaagttctctgaacaggggggaaccccacagaatgtggccactagcagctccctcacagcacatctcagaagcctctccaaaggagattcccctgtgacttcacctttccagaattactcctccattcacagccagagtcgctcaacctcatcacccagtctacattctcgctcaccttctatttccaacatggcagctctaagtcgtgctcattctcctgcgttaggagtgcactctttttcaggggtgcaaaggttcaacatttcaagccataatcagtctccaaagagacatagtatttctcattctccaaatagtaattctaatggctcctttcttgcaccagaaacggagccaattgttcctgaactgtgtattgaccatttgtggacagaaacgattactaatataagagagaaaaattcacaagcctcaaaagtgtttattacatctgacctatgtgggcaaaagttcctgtgctttttagtagagtcccagctccagttacgctgtgtaaagtttcaagagagtaatgataaaacccagctcatctttggttcagtgaccaacataccagcaaaggatgcagcaccagtggagaaaatagacaccatgctggtcttggaaggcagtggaaacctggtgctatacacaggagtggttcgggtgggaaaggtttttattcctggactgccagctccctctctgacgatgtccaacacaatgcctcggcccagtactccactagatggcgttagtactccaaagcctcttagtaaactccttggatcattggacgaggttgttctgttgtccccagttccagaactgagggattcttcaaaacttcatgattctctctataatgaggattgtactttccaacagcttggaacttacattcattctatcagagatcctgtccataacagagtcaccctggaactgagtaatggctccatggttaggatcactattcctgaaattgccacctctgagttagtacaaacgtgtttgcaagcaattaagtttatcctgccaaaagaaatagcagttcagatgcttgtcaagtggtacaatgtccacagtgctccaggaggacccagttatcactcagagtggaatttatttgtgacttgtctcatgaacatgatgggttataacacagaccgcttagcatggactagaaattttgactttgaaggatcactttctcctgtcattgcgcccaaaaaagcaaggccttccgagactggatctgatgatgactgggaatatttactaaattcagactaccaccagaatgttgagtctcatcttttgaacagatctttatgtctgagtccttcagaagcttcacagatgaaggatgaggatttttcacagaatctcagtctggattcttctacacttctctttactcacatacctgcaatttttttcgttcttcaccttgtgtatgaggagcttaagttgaatactctaatgggagaaggaatttgttcacttgttgaacttctcgttcagttggcaagggacttaaaattggggccttatgtagatcattactatagagactacccaacgcttgtcagaactactggacaagtgtgcacaattgatccaggtcaaacaggatttatgcatcatccatcattttttacgtctgagccaccaagtatttatcagtgggtgagttcttgtctgaagggtgaaggaatgccaccttatccttacctccctggaatctgtgaaagaagcagacttgtagtcttgagtattgcactgtacatacttggtgatgagagcttggtttctgatgaatcctcacagtatttaaccagaataactatagccccccagaagttgcaagtagaacaagaggaaaacaggtttagtttcaggcattctacatctgtttctagtctagctgaaagattggttgtctggatgactaatgtaggattcactttaagagatttggaaactcttccctttggaattgctcttcccatcagagatgcaatttatcactgtcgtgagcagcctgcctcagactggccagaagctgtctgtctcttgattggacgtcaggatctttccaagcaggcctgcgaaggaaacttacccaaagggaagtctgtgctctcatcagatgttccttcaggaacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcacattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagagagtcatactccttagctgctggcttggccctgggcatggtctgcttggggcatggcagcaatttgataggtatgtctgatctcaatgtgcctgagcagctctatcagtacatggttggaggacataggcgctttcaaacaggaatgcatagggagaaacataaatcaccaagttatcaaatcaaagaaggagataccataaatgtggatgtgacttgtccaggtgctactctagctttggctatgatctacttaaaaaccaataacagatctattgcagattggctccgagcccctgacaccatgtatttgttggactttgtgaagccagaatttctcttgcttaggacacttgctcgatgcctgattttgtgggatgatattttaccaaattccaagtgggttgacagcaatgttcctcaaattataagagaaaatagtatctctctcagtgaaatcgaattgccgtgctcagaggatttgaatttggaaactttgtcccaagcacatgtctacataattgcaggagcctgcttgtctctgggttttcgatttgctggctcagaaaacttatcagcatttaactgtttgcataaatttgccaaagattttatgacttatttgtccgcacctaatgcttctgttacaggtcctcataacctagaaacttgtctgagcgtggtgctgctgtctctcgccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtactctttgagcacatcaaattcttccattgccgctcttctctgtgccctttatccgcacttcccagctcacagcactgacaaccggtatcatctccaggctctccggcacctctatgtgctggccgcggagcccaggcttctagtgcctgtggatgtggacacaaacacgccctgctatgccctcttagaagttacctacaagggcactcagtggtatgaacaaaccaaagaagaattgatggctcctacccttcttccagaactccatcttttaaagcagattaaagtaaaaggcccaagatactgggaactgctcatagatttaagcaaaggaacacaacacttgaagtccatcctttccaaggatggggttttatatgttaaactccgggcgggtcagctctcctacaaagaagatccaatgggatggcaaagtttgttggctcagactgttgctaacaggaactctgaagcccgggctttcaagccagaaacaatctcagcattcacttctgatccagcacttctgtcatttgctgaatatttctgcaagccaactgtgaacatgggtcagaaacaggaaattctggatctcttttcttcagtactctatgaatgtgttacccaggagaccccagagatgttgcctgcatacatcgcaatggatcaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaagtcgggggtgatatgtgtgtgcacgcctacctcagcgggcagcccttggaggaatcacagctgagcatgctggcctgcttcctcgtctaccactctgtgccagctccacagcacctgccacctataggactagaagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaacaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaactcttgatgattgctttagttttggacttagagaatagagcaggggttgctggagtgaatattgatttttaaagtctttgaactgtggtggtataggtgaagtgactatgcccaaaaatgccaagttttaaaagaagctatgtcataaagttttactttctgtggcaaaagagcgctttagcatttcctcagatgtcacagttgtcctgtctaaaataagtttgtacttctggtgacaatgccagacactcttatgatgtgatcaccttaaacaggagaaggagatttttgccctcagttgctcaacatgaagtactgtggactgaattgtgtcctcccagaattatatattgaggccctaatccctgtgtgactgtattaggcaatagggcatataggagattactaaggttaagtgaggtcatcataagggtggggccttaattcagtagaattggtggcctcctaagcagaggaagagagatttttctttctctctctgccatgtgaagacagtgaggagtcggccgtctgcaagccaagaagagcccttatcaggaacagacttggctagcaccttcatcgtggacctccagcctccagaattgcaagaaaatacatttccgtcgttgaaaccacccagtctgtggtattttgttatggcagcccaggcagactaatacgtgaagcctgctctaaatagataaaataagaaattactacagagggctctttagaaattgtatttaaaaacaagacaatccatatttacctaagatttacagaatgtatgtctataaaaggagggatttctggactagatgatgatgaaaaatgttcatataaaggcacctccagcttcgagttgccaacacaggaggaagaatgctccctgctgttcagatgctgatatgtgtcctgtgcttcctggatggccagtgggatcataagctggtagaagcaagaccttcatccactgacttcatatttcttccacatcctgaactgtggtgtttgactttaaaaataaattaaagcaaatagaaatgtttccattgagattttggcaaaaacccacatgacatttgcgtctgcagagtagacttggaaggcatgcacctggaggccaagtggtattctctggactctctgtccttgcatttgcgtggctgccccgaggactcgcttcttcctggatgtgaagcagaggcacgatggggctgactgagaggctgaaatgtgcttctcttcacagttacatagttttcttctaattaaaaataaattttaagtggtagattatgaaaattccatttgaatcaagattttaaaaattcaatatcaaaccagttgttactgtcttcactctccgttgtttacgattgtgtgcttttcctgaataaagaatgactggagagaca

SEQ ID NO: 1201 - DNA, 1524 bp, Homo sapiens
gagctggagtgaagggagctagtggtaaagggagctggtggaggggtggcggcaggggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttg

SEQ ID NO: 1202 - DNA, 1364 bp, Homo sapiens
aatcccgtgcggcgcgcacaggcaggaggttgcagttgggcgctcagcagctgtggcagccggttgaggtctggcagtagcgttgggctgaagcagcggagttcgccatgcgcgagtgtatctctatccacgtggggcaggcgggtgtccagatcggcaatgcctgctgggaactgtactgccttgaacatggaattcagcccgatggccaaatgccaagtgataaaaccattggtggcggggacgactccttcaacacgttcttcagtgagactggagctggcaagcacgtgcccagagcagtgtttgtggacctggagcccactgtggtcgatgaagtgcgcacagggacctacaggcagctcttccacccggagcagctgatcaccgggaaggaagatgcagccaataattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacagcctccctgcgatttgatggggccctgaatgtggacttgacggaattccagaccaacctagtgccgtacccccgcatccacttccccctggccacctatgccccagtcatctcagctgagaaggcctaccacgagcagctgtctgtggccgagatcaccaatgcctgcttcgagccagccaatcaaatggtcaagtgtgaccctcgccacggcaagtacatggcctgctgcatgttgtacaggggggacgtggtccccaaagacgtcaacgcggccatcgccaccatcaagaccaagcgcaccatccagtttgtggattggtgcccgactggatttaaggtgggcattaactaccagccccccacagtggtccccgggggagacctggccaaggtgcagcgggccgtgtgcatgctgagcaacaccacggccattgcggaggcctgggcccgcctggacctggcagctctagagaaggattatgaagaggtgggcgtggattccgtggaagctgaggctgaagaaggcgaagaatactga

SEQ ID NO: 1203 - DNA, 1562 bp, Homo sapiens
gggaaacgcctgctgctcttgcccttgcccacgggcccccagccccagcccctctcctgtggcccaccacccctgctttggtgccatgcagctgccacccttcgacatgtggaaggactacttcaacctgagccaggtggtgtgggcgctgatcgcaagtcggggtcaaaggctggagacccaagagattgaggagccaagtcccgggcctccgctggggcaggatcaggggctgggggcgccaggggccaacgggggcctggggaccctgtgcaacttctgcaagcacaacggggagtcccgccacgtctactcctcacaccagctgaagacaccggatggcgtggtggtgtgtcccatcctgaggcactacgtgtgtcccgtgtgcggggccaccggtgaccaggcccatacgctcaagtactgcccgcttaacggtggccagcagtccctctaccgccgcagcgggcgcaactcggccggacgcagggtcaagcgctgagcatcgtgagatgctcaccacccgcacccctgaccctcctggtccatcccacccaagtccctaaactctctcttccagtcacccagccctttggaatttctggcccccagaactccaccctggctggatcctgaaacagtggaggctgctgggagccaggccagccccgcccccttggacctgtcagccctcggagctctggcctgtgggcgttggcctgagggtccttggtgccgcgggaacccttcctgcacggccctgtagcgccctctgggccccggttcatggatcttttgtcctcgtggggcctgctggtgactggagccctgccccttcgacttctctgttccttgtggagttcttggatttttgaacctccaggattccacggtgctgtcccaagccagcccttaggagatactgaacaaggctggctgagaagtgcctactcaagaacttcaagatgggatgtcgacttaagaccagccttctccatcttcagcctcctgcagaaccacggtgtcatcgtggaccacgcctgttcattccttccctgacctcagtacccatccgtcaggagcggagtaggactctggagagcaccgtatcactggagggcaccgtgtcttcgcaggctcacctgtggatggagagccgtggggtgagctgacacctttcaatgccccctggttgttcttccccttgttcagcccattgcacccggtacctgcccccatccccaaatcaccgatgggtcctttcccccagcgagaagcatatctctcgaccacctcccgtccgaccccccaaatcgtgatagttgactaaaggacatttttttttcctcctgtgtttttcaacctccaacgttcaagtcaaggaaccgccgataagaagggggtttgagtacccggatgggaatggcaatggcctagcttttattttaggggcaaagagaagaagggcccccgtcagattttaagttgttcagtttttggcacagggtcgggaccctgagtattgagctctggtgaataaaaaggttttctagtcgtctttg

SEQ ID NO: 1204 - DNA, 1407 bp, Homo sapiens
atgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggccggtggcctctcactgcctccgcggcagggttgtcaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaattgcaatatggccttggtatggttttatttgtacttttgtgggggattcgtggatctttagattaaaaaaaaaaaaataggtttttgaacaatttttgcaagtttgcagctgttagttattgatttatttttccaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttcttttttttttcctctcctcagattggataaattatattgctatgtctctgtttctgaactatagaaaagctcaaaattattatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatcccttgaattggaaattgtgccctggagactgtatacaagactggattaaaaagactggattctgttttgtccctg

SEQ ID NO: 1205 - DNA, 2495 bp, Homo sapiens
gcgtcggtccaggcggcgcgcacggtatggcggcggcggcggcggcggcggcgcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaaggtaccttaatttgaagaagtgttctgctttgtattaatagcctaataattattataattgtgaagtaatgtaagcattgtggaagaaaggtgataatgtaactataaatcatgctgtggactataaaattctctgcatttagcatagaacattgaattttattacataagtgtttaatgggtccttctgcattaaaaagttgataaagatatagatgttaagctaaaaagcttgaatttattctgagatgttgtttgaggttttatcaatgtgagttcttaattttccattttgtagctcactcataacttcattgaatgtaattgtatgtgtctaataaactctttaaatgctagaggtatttcatttgatatttagcttctgaaagccctttgttataaagggaagtgattttctaaatttggtagcagcttgaaaacaagcaccacaaatgtaaaactgcatggttctttttttactaatttaatttttttgccaagttatgtgctagcaaaatgtttgaaattgctattctttttctgttagcttggtatatatgacttagactaagtatatgtatgtgatataatatatgtgtacatgtggctaaactgctaatgggcaaagattgttggttcttctgatgctgagtatacatcaagttcatcccatgattattttttattacgagctattgctgatgtgatgctactcttagctgcaccaccagtataaagcttaactgagaaagaacacccctccctcttagttccgtgccagactggtttgttagctttagttgtttcttagtgctctagccatgtcaccctgtggcactaatcaggacactgtttatattcttcctcttctgtgtccctattcactttgtaattattctattttagctggttatatggtagttaattggtagcctgttttcctttgttttctttacttgtgtcaagctccatgtcgttgttttgtgatgagcagtgatttagaactggccagaccttagaagagtcttcagcaagctgccctagggtaggggcgtattctctgtttgttttgtactggtaccccaggaggatgccttgtaactgctctttggtcatgatagtggtaatgaatccattcatgtaaaatgcaatatgtctgttagtttggggcacccgaggctcagtagaggtttagtatgatgccttccctttcttctttgagttatgaagaaactaatttctggcacagtgtgactgcttcaaacctatgttctgctgctatctcctatagaggagggcagacttttttttcttagtgcatttgctggtaggtcaaggagggatggactttgaattagtgttcagagtcacagatcctacgtatgtgctcttcagtagaggattttctgtgatcctacaatgaagggaaagctatataatttattggtacttcctaaagatagagactaaagtcatggtagtattggccaaattaattttaaaactgaacaagtcatgaattttcatataaatcaaagaactttttccttataaaagcttccatttttgaaaagttggatcagttgtaagacctttcatctttagtattgtatgatataattctacattgaaaaataaacacttggcattaaatgggacttggagtcaaaagatctggttttatggtccatcttttaccaatcatttgctgtggatctctttaaaggtcctggaacctttgagcctcagttacctcacttgtaaattggcaaaaatacctacctcacagggttgttgtgaggattcaatgagctaatgtatgttgaaagcactttgtgaattgtaaagtgctacacaaatgttagttgttgttgctgctgtatctgagatgtcttaattttctttttcttcagaaatagtctaataaacctccagggcttttctgttaaagtatactagttggtaaaatgttgaataaacagtttattacaatata

SEQ ID NO: 1206 - DNA, 3332 bp, Homo sapiens
atgatcccaaagagcctggtccaggcagcggaaacccagaggggtctctgcgagccaggagggaaaggaagagaggggagaagtggaggaaaaggggagacacgccccagaggagttggaacgcaggagggaaaggggaccatacccggtagcccgagggaaaaacgaggcgagaggggagaaggcgaccccgcgctgctacccgcggaagatttatggcgcctcccgggttccaaggacaggctgcgttcgtcgctgctgccaccgccgggacccccttcttctgactccgggcccggacccccctcctctcactcagggaaaaccgcgcagggacccaggaccctcaactgggccagaaagcaaagtgcaaggaccagcagcaacttgtgtgcctggagccttgcaatggctacgaagatggctgagattccttctagcccatatgagccgggacagcgaggcatgaaggatactcagagaggtgatgcccctcaaagaggaagcccagagccccgaatcctgcagttggcccgagtgggaaacgtatatctgaaggaggaaagctcaaggagtgggcgactggaagctaagaagtggatcccaacaaagttccttgagaacctctctgtcccacacgttgacctcggtggaaaccagctttggagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaagtcgttcctgggcgagcacaaaccacccaagctgcccgagaacttcgccttcgatgtggtgcacgagtgcgcgtggggctcgcgtggtagcttcatccctgcgcgttacaacagctctcgtgccaagtgcatcaagtgcggctactgcagcatgtacttctcgcccaacaagttcatcttccactcgcaccgaacacccgacgccaagtacacgcagcccgatgccgccaacttcaactcctggcgtcgtcacctcaaactcagtgacaagtcggccacagacgaactgagccatgcttgggaggaccgcggacttggcctggcgactggagctagtggcccggcgggcccaggagggcccggtggcggcgccggcgtacgaagctacccggtgatcccggtgcccagcaaaggctttgggctcctgcaaaagctgcccccaccacttttcccccatccttacggcttccctacggccttcggcctatgccccaaaaaggacgacccggttttaggcgcgggcgagccaaagggcggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacgctggccggcccgcatttggggacttggcagccgaagacttggtgcggagacctgagaggagcccgccaagcggcggcggcggctacgagctgcgagagccttgcgggcccctaggaggccccgcgccggccaaggtgttcgcgcccgagagggatgagcacgtgaagagcgcggcggtggcgctggggcccgcggcctcctacgtctgcacccccgaggcccacgagccagataaggaagacaatcactcgcccgccgatgatttggaaacgaggaaatcctatccagaccaaaggagtatctcccagccaagtcctgcaaatacagacagaggcgaagatgggcttaccttggatgtcacaggaactcatttggtggagaaagatatcgagaacctggccagagaggaattgcaaaaactgctcctggaacaaatggagctccgcaagaagctggaacgggaatttcagagtctcaaagataattttcaggatcaaatgaagagggaattggcttatcgagaagaaatggtgcaacagctgcaaattgtcagagataccctgtgtaacgaactcgaccaggagcggaaggcgcgctatgccatccagcagaaattgaaagaagcccacgacgccctgcaccatttctcctgcaagatgctgacgccccgccactgcactggcaactgctccttcaagccaccgctgttgccctagggccggcctggccgcacccctgcgccctcaagccatgctgctccttgtaaatacccgctgctgcggtggccctgagcgaggaacaagccattcggacccgaccgatgtaaatacagccgcccgtccgcccgccttcctcccgggctccccggccttgcccgccccctcccgggcgtccctgtccagggccccggcttggtttccaagtgtaaataccgcctcgcgcctcaaatccccctaccccgtgtgaactctagggcatcggacctcaaggggttaactggacagacggggggcgggaggggagagcgccccctcccattgtatagccttgaacccgattgtgaatacaatgtagcaacttcgctggcgcctgccccgcactccccgtcccgtccacttctgaaactcctgttcctaatgacaaagtggctatgtgcaatggatataaatgtactgtgagtctctcggttcagtattaggttcactttaatttatttatgctgtaagttatttttgcttccttctcctggacccacttccagtcccgttttgcattcccctttggattttgctttggctattttttgttgtaacctcttgatgtaacagcactttaaaagggcgacaactgactcacgagatggcaaccacctggagcctgtttggggagaccaccctgtacccgtgactttcgtttttaataataataataataataataa

SEQ ID NO: 1207 - DNA, 5512 bp, Homo sapiens
gcaggctgcggacccagttgcgagaggcctattatctgctgatccaggccatgcacgacctgccccctgactcgggcgcgcggcggggcggcaggggcttggcggatcacagcttccccgcgggagcccgggctccgggccagccgccttcccgcggcgccgcgtaccgccgagcctgcccccgggacggggagcggggaggcggcggacgccctcggcagcaggtgtccccgccccggtcgcctcagagggagccgcggggaggccagctgcggactcctcggatgcggccgtcctgcagcagaagcctcgagagcctccgggtgggtgccaagccgcctcccttccagcggtggccgagcgacagctggatcaggtgcggcgcgcaccgggactgggacgagcccccgccacgtggaggcaggatggacggctggagtggggaccgcgcccgggcggctgcacccaccggcctccagcctccaggctgcaaggaccacggctgctcctcgggaagccctttcagggatccagcggggtcctctgtgatacgcagtggcaaaggagaccgccaggaaggcccctccttcctcaggccgccggcagtgacagtcaagaagctgcagaagtggatgtacaaagggcgtctgctgtccctgggaatgaagggtcgtgcccgtgggacggctcccaaagtcacaggaacgcaggcagcctccccaaatgtgggcgctttgaaagtgcgtgaaaaccgtgtcctgtcggtgcctccagaccaaagaattacgctgacagatttatttgaaaatgcctatgggtcttcaatgaagggaagagaacttgaagagctgaaggataatattgaattcagaggtcataagccacttaacagcatcactgtttcaaagaaacgcaattggctatatcagagtactctgaggcctcttaatctggaagaagaaaataagaaatgccaagatagaagtcatttatccatctcacctgtgtctctacctaaacatcagctatcacagtctttcctcaaatcatctaaagagtactgtacatatgtggtatgtaacgctacaaactcttcattatcgaaaaactgtgctttagattttaatgaggaaaatgatgcagatgatgaaggagaaatatggtacaatcccattcctgaggatgatgaccttggtatatcaagtgccttgagttttggtgaggccgactctgctgttctgaagctccctgctgtcaatttgagcatgttgtctggcagtgacctgatgaaagcagagcggcatactgaagactcactgtgctcttccgaacatgcaggtgatattcagaccacacggtcaaatggaatgaatcctatacatcctgcccattccacagaatttgtgcagcagtacaagcaaaagctaggacacaagacacaagaaggtataatggtggaggacagtcccatgttgaaatctccttttgcaggttctgggatcctggctgctacaaatagtactgaattgggaattatggaaccatcttctccaaatcctagccctgtgaaaaaaggcagttcaattaattggtcattgccagataaaataaaatctccacgaactgtgaggaaactttccatgaaaatgaaaaagttgccagaatttagccgaaagctaagcgttaagggaacattgaattatataaacagtccagataatactccttctttgtctaaatataactgccgagaagttcatcatactgatattctgccctctgggaacacaaccaccgctgctaagaggaatgttataagccgataccatcttgataccagtgtatcctcccagcagagctaccagaagaaaaactctatgagttctaagtattcctgcaaaggtggttaccttagtgatggagactcacctgaacttacaactaaagctagcaaacatggatctgaaaacaaatttggaaaaggaaaagaaataatttcaaatagttgtagcaagaatgaaatagacattgatgcttttaggcattatagcttttctgatcaacctaagtgttcacagtacatatctgggctcatgagtgtacatttctatggtgctgaggatttaaaaccacctcggatagattcaaaagacgtcttttgtgcaattcaggtagattcagtaaacaaagcaagaacagctttgctcacatgccgaacaacatttttagacatggatcacactttcaacatagaaattgaaaatgcacaacatttgaaactagtagtattcagttgggaacccactccaagaaaaaatcgagtttgttgtcatggaactgttgttcttcccaccttatttagagtgacaaagactcatcagttggctgtcaaacttgaacctagaggtcttatttatgtgaaagtgactcttatggaacagtgggagaattctcttcatggactagatataaaccaagaaccaataatatttggagttgatattcaaaaagttgtagagaaagaaaatataggactgatggtgccccttctgatacagaaatgtattatggaaattgaaaagagaggctgtcaggtagtaggcctgtatcgattatgtggttcggcagcagtcaagaaagaactgcgagaggcttttgagagagatagcaaagctgttggtctgtgtgaaaaccagtacccagatataaatgtaataacaggtgttcttaaggattatttaagagaactcccttctcctctgataacaaagcagctttatgaggctgtattagatgcaatggcaaaaagtcctttgaaaatgtcatcaaatggttgtgagaatgacccaggtgactctaagtacactgttgacctgctggattgtctgccagagattgagaaggcaaccctaaagatgttgttggatcatttgaaattggtggcttcctatcatgaagtgaataagatgacgtgccagaatttggctgtgtgctttggaccagtattattaagtcagaggcaagagccttccacccataacaacagagtctttactgattcagaagaacttgcaagtgctttggattttaaaaaacacattgaagttcttcattacttactccaactctggccagtgcagcgtttaactgtcaaaaaatcaacagacaatttattcccagagcagaagtcttctctgaattatctgaggcagaagaaagaacgacctcatatgttaaatttgagtggtactgattcatcaggagtacttaggccaaggcaaaaccgattagacagtccacttagcaatcgttatgcaggagactggagcagctgtggggaaaactactttttaaatacaaaagaaaatttaaatgatgtggattatgatgatgtcccttcagaagatagaaaaatcggagaaaattatagcaaaatggatgggccagaagtaatgattgaacagccaattcccatgtccaaagagtgtacatttcagacatatttgacaatgcagacagttgagtctacagtggatcgaaaaaacaatctcaaagatctacaagaaagtattgatactttgattggaaatctggaacgtgagctcaacaaaaacaagcttaatatgagtttttgagattgagggtttttttttgtaatgtcttaaagtttcaaatctgtttttgttttattttcttataccacccacagcgatgttttcatttttttactcttgaaatctttaattaatttttaataagtttatctgattcaattaaaaacactattcattaatacaatttttacttatctcactagaaaacttttctggggatcaataaaacttggacttcttgggatattttactaaatcttgccaactctatggagataactttcaaatgcacttaagaaggttcacataagttattagcccctcaaggtttttctgctttatgggaaccactcttctgtagctgagacagatgtccttttttttgttgttttttgagacagagtctcactctgtcgcccaggctggagtgcactggtgcgatctcaggtcactgcaacctccacctccctggttcaagtgattctcctgccacagcctcccgagtagctgtgatgacggggcccaccaccatgcccagctaattattgtatttttagtaaagatggggtttcaccatgttggccaggctggtctcgaactcctgatctcagatgatccgcccaccttggcctcccaaagtgctgggattacaggcgtgagccactgcgcctggcctctagatgttcttttagaggaacatcacagctgctcagtctgatttgcagtactggtcctggtacactgcaacatcctttggtcaaattttatttgtaatgcaaatgctgctataagaaaatctttttataaataaaagtgaaattatacaagtattaatgttttctgtattaacagtaattatttaagcttataaaaattaaatatttttataatcctgaaactgtatatatttataaatgcatatatgtatagatatcaggatgggggaggggttattgtagaatcacatgtatttttaaagtatatatgtcatgaggccaaaattattatcttaaagtatttttttcagggaaagaacatttaaattaaaggaggaattacataaaaacacttgaacaataatactctagaagcatctgaatagaaataatagactttctttcctttattcacagaaagtcacaatgtcccctgggaaaagtcatcttttaaatttgaaatcctctaactccttaagggattaagtacccagatttctgcactggtgacttagatttaataaatctgctcctgttctatgcatttttatattctgctttgttttaattatttatttgtagtagtacatttataacattgactttataattacccccatttgtttctaaatagtcttgccagcatattacatgttactgatttttaaaaattaacttattttggctaagtatatatacaatgttatagaatcacagtaatgtttgaaaatgtaaatttagaaggcttttgtattaaatcaaaatgtatttttttaacttttatatctacagaatatgtaattttaaaattataaatagactttaagttaccaacttttaagacatggcagccattgaaaaactggcttcctgatgtttttctaaatattaaagtacttaaaatatttctatgcaataaatattgataaacagacattatttaatttgaaaacccattgttaaaaaagataaatatttttatatgaaattttcattttttaaaactttgtgttaacaattcagaagaataccaagagaacatatatattgagtaaacagtcaaaggaaagtactcttgaatgttttataggaaagctgtctcagtttccttccttttgttgctatatcatgtatgaattgaataaattgctctagaaatgtaaaaattttattaaaatatta

SEQ ID NO: 1208 - DNA, 1353 bp, Homo sapiens
atggatccggggaatgagaattcagccacagaggctgccgcgatcatagacctagatcccgacttcgaaccccagagccgtccccgctcctgcacctggccccttccccgaccagagatcgctaaccagccgtccgagccgcccgaggtggagccagatctgggggaaaaggccattgaaagcgccccggagaagcgactgacacttgcccagatctacgagtggatggtccgtactgtaccctacttcaaggacaagggtgacagcaacagctcagcaggatggaagaactcgatccgccacaacctgtccctgcacagcaagttcatcaaggttcacaacgaggccaccggcaaaagctcttggtggatgctgaaccctgagggaggcaagagcggcaaagccccccgccgccgggccgcctccatggatagcagcagcaagctgctccggggccgcagtaaagcccccaagaagaaaccatctgtgctgccagctccacccgaaggtgccactccaacgagccctgtcggccactttgccaagtggtcaggcagcccttgctctcgaaaccgtgaagaagccgatatgtggaccaccttccgtccacgaagcagttcaaatgccagcagtgtcagcacccggctgtcccccttgaggccagagtctgaggtgctggcggaggaaataccagcttcagtcagcagttatgcagggggtgtccctcccaccctcaatgaaggtctagagctgttagatgggctcaatctcacctcttcccattccctgctatctcggagtggtctctctggcttctctttgcagcatcctggggttaccggccccttacacacctacagcagctcccttttcagcccagcagaggggcccctgtcagcaggagaagggtgcttctccagctcccaggctctggaggccctgctcacctctgatacgccaccaccccctgctgacgtcctcatgacccaggtagatcccattctgtcccaggctccgactcttctgttgctgggggggcttccttcctccagtaagctggccacgggcgtcggcctgtgtcccaagcccctagaggctccaggccccagcagtctggttcccaccctttctatgatagcaccacctccagtcatggcaagtgcccccatccccaaggctctggggactcctgtgctcacaccccctactgaagctgcaagccaagacagaatgcctcaggatctagatcttgatatgtatatggagaacctggagtgtgacatggataacatcatcagtgacctcatggatgagggcgagggactggacttcaactttgagccagatccctga

SEQ ID NO: 1209 - DNA, 1712 bp, Homo sapiens
tgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttggagcttgcggcccccacccaccgcgtggcgtccccaggcacgcctagaattctagcacctcaggatcagtccagcccccatttacaattggggaaactgcggctccgaaagggtcagagggtacccgaggtcaagcagtagagagcggactcgaacttaagctcttgctcttaggctgagacgccttgatgtggccaccggctaccctctagtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaaggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagtttgtccagcagaggggcactgcgtgtctcatcaggatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagtctaagaaccactcaccctgctacatgtctctagagtccattcatttcattgccgtgtag

SEQ ID NO: 1210 - DNA, 2989 bp, Homo sapiens
tcagtctttcgcggcccgggagctcagcagagctaccagctgccctgttggcttcgctggtcggatcgtcctcctggccccgccaaacaggcggggggagcggccccgactgtggggccatggcagtagtctcctcgttcgccgccgccgctagcctagctgagtcgccggcttctgcgctaggggctcccaccgcctccgcaggctaaggagccgctgccaccaacgagctgtgagggttactatgctccctctttgccgccgtctcctcctcttgcccgcgcaggcacccctctggctgctcagtcctgcctcagtgtcaaaccagaagagaagtaaaattcaacaaaaatttatgtgtggagttccttcttaaaagaagaaaaaagtgattatttagactatggatcggagcaaacggaattcaattgcaggatttcctccacgtgtggagcgtcttgaagagtttgaaggaggtggtggaggagaaggaaatgtgagccaggtgggaagagtttggccatcttcgtatcgagctcttataagtgccttttccagactgacgcgtttggatgatttcacctgtgaaaaaatagggtctggcttcttttctgaagtgttcaaggtacgacaccgagcttctggtcaggtgatggctcttaagatgaacacattgagcagtaaccgggcaaacatgctgaaagaagtacagctcatgaatagactctcccatcccaacatccttaggttcatgggtgtatgtgttcatcaaggacaattgcatgcacttacagagtatatcaactccgggaacctggaacagttgctagacagtaacctgcatttgccttggactgtgagggtaaaactggcctatgacatagcagtgggcctcagctaccttcacttcaaaggcatttttcatcgggacctcacatctaagaactgcctgataaagagggatgagaatggttactctgcagtggtagctgactttggcctggctgagaagatccccgatgtcagcatggggagtgagaagctggccgtggtgggttccccattctggatggcacctgaggttctccgagatgagccctataatgaaaaggcagatgtgttctcttatggtatcatcctctgcgagatcatcgcccgcatccaggccgatccggactatcttccccgcacagagatggatcccaaactgcgcccatcttttgtggagattgggaagaccctggaggaaattctgagccgcctacaggaagaagagcaggagagggataggaagctgcagcccacagccaggggactcttggagaaagcacctggggtgaagcgactaagctcactggatgacaagatcccccacaagtcaccatgcccaagacgtaccatctggctgtctcgaagccagtcagatatcttttcccgtaagcccccacgtacagtgagtgtcttggacccatactaccggccacgagatggtgctgcccgcacccccaaagtcaacccttttagtgctcgccaggacctcatggggggcaagatcaagttttttgacctgcccagcaagtctgtcatctctctggtatttgacctggatgcaccagggcccggaactatgcccctggctgactggcaggagcccctggccccacctattcgccggtggcgttccttgcctggttcgcctgagttcttgcatcaagaggcttgtccatttgtgggccgggaagaatcgctatctgatgggcccccaccacgcctaagtagtctcaagtacagagttaaagagatcccaccattccgggcatctgccctaccagctgctcaagcccatgaggctatggactgctccattctccaggaagaaaatggttttgggtccaggccccaggggaccagtccatgccctgcgggtgcttctgaggagatggaggtagaagaaaggccagcaggctcaactccagccaccttctccacctcaggcataggcctgcaaacccagggaaagcaggatgggtgagggggtttagtccctgcctcaccttggggatggaccttcagctgaaaccatatggccccctaggtgcacagccttgattcttccctggagcctacagagcaggcaggctaggccaagccaggctcaacttctgggctcccagtgcccattggctgtgtatgacgggaggcagcagtgagaggccttcctagttagggccaacagctgataccaagcctctgaaatccagcaaggaggtctgcctcccaccagaccctctccagtgtacttccccagataggaccagaggatgtctagttctaggctgagctggcaggcagctattaccccggttctttccccaccccaggtctgtctcttgccttttcttggggcatataagctactgagtggaacatggagctgatcaagaggccgtaatggtcatggctgtttcccagacctgaatattggggtgcttcttgccagtattctaagacatttgagtaattgctgtttgcacttactgcatggtcagaccacgtcactacatttctatgcaaggggacagcaaggcagcgtggtggtcatggctcttagctaacctattcaaagaccttttcctgttgattaatctattttcatatttataaaggagtcttaatgttctgccccataagactttcaaccttgtggttgggagtggggctggttttgtaggccctagggcctgcttctatgtatttatcaacatgtgatacattcaattggttaaatggtttatacagggactgatttgcttcccttcctgccatggctggagctttgggaacagtctgtccttacagagctgcaataagaaataaccaaagatgaagctggtcaaatattttcataacttgcttctgttgatttttttttttgtaaaactttcccaagacattttcagacttaaaaataaagtcagtgttacaggtg

SEQ ID NO: 1211 - DNA, 814 bp, Homo sapiens
aacagggcttcgtcttctttgcagagccatgggcagcaggaagaaggaaattgccctgcaggtcaacatcagcacccaagagctttgggaggaaatgctcagttccaaaggactaactgttgttgatgtctatcaaggctggtgtggcccctgcaaacctgtggtgagcctcttccagaagatgaggatcgaggtcggcctggaccttctgcactttgcattaattaaagatgaggctctttctgatgaagatgaatgtgtttcccatggaaagaataatggtgaagatgaggacatggtttcatcagagaggacctgtaccttggccatcattaaaccagatgcagtggcccatggaaagactgatgagattatcatgaagattcaggaagctgggtttgaaattctaacaaatgaagagagaaccatgacagaggcagaagtgcgacttttctaccaacacaaagctggagaggaggcatttgagaagctggtacatcacatgtgcagtggaccaagccacctcctgatcctcaccaggactgagggcttcgaggacgtggtcactacctggcgaaccgtcatgggcccccgtgaccccaatgtggccaggagggagcagccagaaagtctccgagctcagtacggcacagaaatgcccttcaatgccgtccatggaagccgggacagagaagatgctgacagagaactggcattgctcttccccagtttgaaattttcagacaaagatacagaagcccctcagggtgagtccagtacacagccaaggttgaagatcactgacctagactaa

SEQ ID NO: 1212 - DNA, 3328 bp, Homo sapiens
agtgaagcctgcccacttgtgaagacggagactccccgctccccggatgagaagcaagtgcgtcagagggaagcagcccaactggttgctgagttgtggaaaataagctgggggagaaaaaacacttcttttaaaaatcaggttagggatgaatgtgcagggcgtggttcctgtgcaattatctgctctgctggctgcggggctccctgcttctcccgggccgctgtgtcaggcttgtgcctgttgctcctcccctccactcctccccctcctcctcctccgcctcctccccctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcattgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtcacttctcttgta

SEQ ID NO: 1213 - DNA, 6210 bp, Homo sapiens
atgaaaaagaagcagacggtgcagggcaccttcagcaaactcttcgggaagaagcacaccacgacccccagcacctccctctacgccaccaatccgccctggatcttcacccaggaggccccggaggaggggaccgggggcttcgatggcatctattatggagacaatcggtttaacacagtgagcgagtcaggaacagccacgctgaaagctcggccaagagtccggcccctgctgaccttccttccgctgaatgcccaggaaaaccatgggctggctgtgcccaccccctcggttccagatgattttgcagacaaagaagtgacaggtaccagctcactagtcaatggcaacctccgactgtacagctctgtgggtgacctgaggcctggacaatatggccaggatctactcatccccccacctcccccaggcccagccccagggccccctcaggacatttcagaacctccaggggggtcgccactgccatctccaccttccacagcacccccaccacctcccctgctgctggaacccccacccccgcccagcatggccccacctccacccccagtattggaggccctatccccaccacacactctttcctccccatccatacccacccctcctgacttcattccccctgccccacccttggcctttctagcccccccaccgcctcctgtgccagccccagcacccccagctccagcatctcctcacacagtggggactcgtctctttccccctgggggtgtcaccaagtggaaatcagatgtagcactgaatggcaggcaggcagaggccaccagagccagccccccgagaagccctgctgagccaaaggggagcgccctgggacctaacccagagccccatctcaccttcccccgttctttcaaagtgcctcccccaaccccagtcaggacttcgtccatcccagttcaggaagcacaagaggctccccgaaaggaagagggggccaccaagaaggctcccagccgactcccactgcctcccagcttccacatccgccccgcctcccaggtctacccagacagggcccccgagccagactgccctggggagctcaaggccacagcaccagccagcccaaggcttggccagtcccagtcccaagcagatgaacgagctgggactccgcctccagcccctcccctgccccctcctgcaccccccctccctcccccagcacccccacttcccccagctgcacctcctttgccctgtgctcagaaggcagcccatccacctgctgggtttacaaaaacccctaaatccagctctcctgctctcaaacccaaacccaacccccccagcccagagaacacagcgtcttcagcacctgtggactggagggaccccagccagatggaaaagctgcggaacgagctggcagcctatctctgtggctccaggagagaggaccgattcctcagtcacaggccaggcccaacagtggcccctcagagcaaggagggcaagaagggcccccgcctgcctgagaaggagactctcctgagcctgccagcaaaggacactcccccaggtgttcctgaaaagagtcttggcggcagcagcctgacagagacagaggctgcccccagcctgaccctgccctctgtggactacattccccaagactctccaactcccagtgtgcggcagatccggaatgagctggaggcccggctctcctcagcagcagagaaggaggctaagcccagcataggatctctgccccctaagcctcggctagaagggggaagaatttgtgaaaacggggctgatgatgacaaactctccaagcctgtggccaagaatctgccacctcaatccaccaccctgctgccaactacatcactccagcccaaggctatgttgggaccagccataccacccaaggccacacctgagccagccataccacccaaggctacactttggccagccacaccacccaaggccacacttgggccagccacaccactcaaggccacatctgggccaaccacaccactcaaggccacatctggccctgccatagcatctacagccacaactctgcccaccaccacatcccaactgatggcagagaaggactcaggcccagctggccagccagagaagccagcatctcaagaagtttccactccctcccaggcaaggggagaggggtccccctcagaggccactaggctgcccacacagggagcccgctcatctgcagccttcccaccaaagacatctcctggtggaggagaggtgccatgtctctacaagccccactgccaccagagcagcctcagccgtgaggttgctgtggtgatgcccaccctggccagaggaggggctgcagggccaggggagcccgtggaggtgaaggagcccccagggctgccagccaagcctcctgcctcggcccagcccactgatgaactcctcaggcacccggtgactggggaggtggtggagcggggctcgccgatggccctgctcctggcggccaggcagagggctcagaagggaaggtctgtaggggctgccctgggtcggtcctctctgccaggaagtctccgtgaccacagccaccaagccgaggccagctctgacagcatcttccacagccagggcacgcccaactccttcactgtggtgcccaagttacccaaggaggctgagaaggactccccgctgacgaccgaaatacccaataagtgggggccgcggctgggaagagacgcagagggcacagagctgagccgcaggcacaactggacaaagccagagccccaggcccctgtggcctgggaaagagtagctccctccaacctcccccagggccacccgctgcccaagtccttctcctccccaccttctccttcgaacaagagggaggaggaggaggaggagttcaacttcgaggtcatcccaccgccgccagagttcagcaatgaccctgagcccccggccccggccctccagtatctgggccgccagagctcccctccccggaacaactactcagacttgaggcagctcccgaacgctggccccggggcgcccccggctctcggcttctcgcgctttcccgcgggcgcgcgctacgccggggctgggggcctggagcgcttctcgggagggggccgctcgctcataaagaagcgcctgtacgtcggggagccgcaccgaggcccagggctaccccacggtggcaccggccgcagcctgagctctcccaactgcttcgggccgcagcccggaggccccgagatgcggcgcgtgaactcggcgggtcgcgcgccccccggaggcctgcacgcgccgaggctgtccctggagggcgccgcccggggcgccgcggaggccaagcacaaagcgcccggcagcgccgactacggcttcgccccagctgccggcaggtctccctacaccaccacccgctatggaagccccatcaacacgttcaccgtgaggcctgggacccgccatcccatctcctatgtctgctcaggggcccatcggaaagccacctcctgagccaggggttctcttagctctactccaacaaactgtgtctttaaggatctgggcacttgtttcttgtggggggtgggaggtacacagcaggtgttgggcgacctgactcagacacagaggagtctttgatccccaaagaccaacgatgagaagcagtggcccaggaagaccgagagtgggcttctgtttcccaaagcgctggtgtgactgtggactgtttacacgtggggggtgggaggggaaggagggtagagagaaggaaccattaaggacctgggcgctgagtttctgctctctggtactatctgctttagcaagagttatttaaaacagttttacaagcacggcctactgagcaggttctgaaagcaaggggtggggcactgactgaactggaacccatcgagatagctgtgattgcctgtcaggcccttgcaaagggctgaggcccagctctgtctggtgggtgtgcagggcaccgaagggagatctttagcctccatcacctgccatcccaagcaagagtggacacctggggttcctagccgcattgaggtgggaccaggaatgtgtatgtataacatgtggagaaggaccatgtgtggggtggggagtgaagctcccacatgtggaatggaagccctttgcattggccaagggcagaggtgggagattgatggttcatttttccttggccctagcccttagctacagggaggcctagagagaggacacttggcaagtttaggatgggaaacaaggttaagcctggctttgctattcagacctgtgcagccctgattttggggactgggcccaaggagccatgagtcttaggcttgacactaggggccttacatggccaggtctcatatgggatttggagaaggcatttttcctaacactgatactacaagtcaccaatactcttgatgccttaagatgctagaaagccttggagagtggaggcagcagagatgggaatggaggtctgaagaagcttgctgctgttggggaatgtgtttgggaaagtcaagagtggtaggattggttggctgggcgcggtggctcacacctgtaatcccagcactttgggaggccgaggccggtggatcacttgaggtcagaagttcgagaccagcctgcccaaatggtgaaaccccatctctactaaaaatacggaaaaaaaaaaaaaaagagtgctaggattgggccagttaagagcaggggagacctggctgggcatggtggctcacacctgtaattctagcactttgggaggctgaggcgggtggatcatgaggtcaagagattaagaccatcctggcctacatggcgaaaccctgtctctactaaaaataaaaaaatgacctgggcatggtggtgggcgcctgtagtcccagctactcggggcgctgaggcaggagaatcgctcgaacccaggaggtggaggttgcagtgagccgagattgcacaattgcactccagcctggcgacagagcgagactcgtctcaaaaaaaaaaaaaaaaaaaaaaaaaggagcaggggagacctatcagtagggtgaccacgtgtcctttgcctgggcagtccaggtttatgcttgttttccagtgaattagacccccttccacttttcaaaaaagtcctggtttagatgctgtgatcaccaaacatatcaggaaacaatattccttggtcttgcttccctatcttcaggtactggtgggccaaattcctgggaccaggtcaaggtgggctgcctcagtaagaaggaaggactggagagtgcccatttcagaggagcaggctggtgggggccagccagaaagtagttccctttggggggaagatgttggacctttattatttgtggtaaccagccgaggctggttgtcaggacagcaggtgagccactttagggaagaaagtgcaggggtgggtggatgcccagattaccaaggccagccaccctgatggggtagggtctggttatctgtgttcaagaagcaaatcccaccccagccccagcactagctctctatgtatgtattttccctgtacaatgttttataaaagagatcattaatttatctgctatgttaaggctcgaggggtggggcgtagactctcagctgtatattgctctggggtgggcagggaaggctgagtctcacttgacttggaagataaacaggccagtttggactggcctccagctccgtggctgtgtttgtctaacaaggatttgggtaactactggatacaagccactgtgcttagtatggatagactgccatcagctcacccacatgactcctgttcatggcaagctaatagtctgtctggtggaagaggattgaaaaagcacacaaaaacatcataaattacaaggagtagtaagaaggaaaaaacagggaacgtgagagaataactagcgagtggggagaggagtggatttactttaacagggtagtcagggaaggcctcttgtggtggtgacatactgatttaggcaaagcgtccagcacgtgcctagcgcttagtagttgctcagcaaatggcatctttgggtgatgaatacctcacatttgtatatggcctgtcacagttttccataaagcttttttttttaaggccat

SEQ ID NO: 1214 - DNA, 8361 bp, Homo sapiens
actacagacggggtttctccatgttggccaggcgggtctcgaattcccgacctcaggtgatcagcctgcgttgacctcccaaagtgctgggattacagacgtgaaccactgcgcccggcctggagattatattttaaagttattttgaatactccctggaaaagttcttggttcatacttatacccgtaagtcaaaagatttgtcaaatattcaagaacaatcaaacaatcacttaaaaatactgtataaaagtttctatttcggcatactttacttttacttaactaaaatttcaaataaaatgtatccacttttatgatctcaacaagatcggtcattcctatagcggagttgaaaactttcaacttattcacaattatcaaaagaatggagcagcccccacagagacttccagcaatgagttgtaaaatgcagtctgcattaagtagcttccttacaatcatcccgatggtaaaagtgtcaaatttcgcaaacgcctggacaaggaagtgaaatgatcatctaataacgcagttgactcatctgtcaaataagcgagtgggccagggtccctgagctcactaccctcagattctaactccagcttcacatcattaggcgtaagcagccaattgggccgtctgggagccgtgcatcctgggagttatagtttccggctccctccttcagattacaagctccacagagccgcgggaggacggttgcctggtattattagcaagcagcaaatatggcggtggcgcgcgtggacgcggctttgcctcccggagaaggatcagtggtcaattggtcaggacagggactacagaaattaggtccaaatttaccctgtgaagctgatattcacactttgattctggataaaaatcagattattaaattggaaaatctggagaaatgcaaacgattaatacagttatcagtagctaataatcggctggttcggatgatgggtgtggccaagctgacgttgcttcgtgtattaaatttgcctcataatagcattggctgtgtggaagggctaaaggaactagtacatctggaatggctgaatttggcaggaaataatcttaaggccatggaacagatcaatagctgcacagctctacagcatctcgatttatcagacaataatatatcccagataggtgatctatctaaattggtatccctgaaaaccctgcttttacatggaaacatcatcacctctcttagaatggcacctgcttacctacccagaagtcttgctatactttctttggcagaaaatgaaatccgagacttaaatgagatctcttttttggcatccttaactgaattggaacagttgtcgattatgaacaatccttgtgtgatggcaacaccatccatcccaggatttgactatcggccgtacatcgtcagctggtgcctaaacctcagagtcctagatggatatgtgatttctcagaaggaaagtttgaaagctgaatggctctatagtcaaggcaaggggagagcatatcggcctggccagcacatccagcttgtccaatatctggctacagtctgccccctcacttctacactaggtcttcaaactgcagaggatgccaaactagagaagattttgagcaaacagaggtttcaccagaggcagttgatgaaccaaagccaaaatgaagagttgtctcctcttgttcctgttgaaacaagggcatcccttattcctgagcattcaagccctgttcaagattgccagatatcccaggaaagtgaacccgtcattcaagtgaattcttgggttgggataaacagtaatgatgatcagttatttgcggttaagaataattttccagcctctgtacacactacgagatattctcgaaatgatctgcacctggaagacatacagacggatgaggacaagttaaactgtagtcttctctcttcagagtctacttttatgccagttgcatcaggactgtctccactatcacctacagttgagctgaggctgcagggcattaacttgggcctagaagatgatggtgttgcagatgaatctgtgaaagggctggaaagccaggtgttggataaggaagaggaacagcctttatgggctgcaaatgagaattctgttcaaatgatgagaagtgaaatcaatacagaggtaaatgagaaagctggactattaccttgtcctgagccaacaataatcagtgctatcttgaaggatgataaccacagtcttacattttttcctgagtcaactgagcagaaacaatcagacataaagaaaccagaaaatacacaaccagaaaataaagaaaccatatctcaagcaacttcagagaaacttcccatgattttaacccagagatctgttgctttgggacaagacaaagttgcccttcagaaattaaatgatgcagccaccaagcttcaggcctgttggcggggattttatgccaggaactacaaccctcaagccaaagatgtgcgttacgaaatccggctacgcagaatgcaagagcacattgtctgcttaactgatgaaataaggagattacgaaaagaaagagatgaagaacgtattaaaaaatttgtacaagaagaagctttcagattcctttggaaccaggtaaggtctctacaggtttggcaacagacagtggaccagcgtctaagttcctggcatactgatgttcctcctatatcaagtactcttgtgccatcgaaacatccattatttacccaaagccaggagtcctcttgtgatcaaaatgctgattggtttattgcttctgatgtagctcctcaagagaaatcattaccagaatttccagactctggttttcattcctctctaacagaacaagttcattcattgcagcattctttggattttgagaaaagttccacagaaggcagtgaaagctccataatggggaattccattgacacagtcagatatggcaaagaatcagatttaggggatgttagtgaagaacatggtgaatggaataaggaaagctcaaataacgagcaggacaatagtctgcttgaacagtatttaacttcagttcaacagctggaagatgctgatgagaggaccaattttgatacagagacaagagatagcaaacttcacattgcttgtttcccagtacagttagatacattgtctgacggtgcttctgtagatgagagtcatggcatatctcctcctttgcaaggtgaaattagccagacacaagagaattctaaattaaatgcagaagttcaggggcagcagccagaatgtgattctacatttcagctattgcatgttggtgttactgtgtagcatgtcttttgggaggcagatatccacttaacttttcttaaaaatactttcagttgcctttgcttttttttggagggaaatactccctacccctaattttgttactacttatatagaatttgtattcatgtcttatatttttcagattctagatattgagctgagttttcattttgattttgttagctttttacttagctgtaaggtaccaaactatttatattgaaagctatatgcactttatttcttaactgaattgcatcaacaatgttcctgtttctttcatgtactcatttactttcaaaaataagctagaatatattaaagaaaatagaaaaaattaccttaaatatataaataagagaattttggcccttctgtgtctgagaaaattaattatatagcaaggaatgaaatttgataaagcaaatataaatgagaaatatgaggattgtgaattattgaaatttgccagtctccctggtgtaaaatgtttttttaaagccttttttcctcctttcggagtcaaggaaagcctttctataagcaaattaaggaagaaaaggtaggattataagatttctcaatggggatgattaaattgtctcatggaaaacttcagttaatgtcatgcatcagttttaacatatgaagtaaagtgttctatccaggattaaagtcaagtttacttaggcaacacaagaatatttcacttagatatgaagaaaggaaacactagtctccattcacttgaaatactctcatggcaaatatttatcctctcattaagtgctttttcaccctataggtaagcatttttgtgccaacatgttgtcagaaattaatgtatgttcatctcctctgttcctgcttatttttacttatatatttcagcagaaggtccgtggccattcacttcaattttgacctctgtcccatagtgaagaacatttaaagtaatactactggtcgaatatgaatgactttttaggaactactttttgtctaacctgaaaaagttccacatttggaagacaatttaatgatggtgaagaaataataaacctcactttacttgttaaaagggatatatatatatatatatatgtctgcaacttcagggagaaataagattgtgtttgaatattgtaggtagatgcatttgtaattaaggataatatcgtttaacaacatgtatttggtttccctcaacttacagacatacagctatttaaaactatggcaatacttaagcatctctaaatttaggtgctaaatatctattattctgttgtagtcattaggtgcccttctctgaagttatgtaaaataaaagcatctgatccttcaaggataaagttgaggatcacatggtacgtggcatttgttgttattgttttttaaagagatggaggctggctctgttggtgcggtgccatgatcatagttcactataacctcgaactcctggctcaagtgatctcccacttcagcctcccgagtatctgggattataagcaagagccactgctcccagctcatggtatttgttgatagtcataacatttttcctgtatggtaagacgtatttttctcagtttataaatacgtagcactcaggttgagacgacttggattttattcttagaaatccagaatcccttgaaaaggaaatattttctgtttcttataaataaaagagtaatcttactttcagaaggattttccttagtgaaacatgtgtaacattgaatgcatgttaaataaaaatggaatttctaactttttttcaatagtgctaattatcttttctgaatgattttgaatgtcttcttaaatataccctatttttctattttaaagttaagtgcctcacttgctgtccatagttagacaaagaaaaaccaatttccactgcactagtaccaaaatactactttatacattagtttttcataaaagctgctggaatgtcatgattcagtattacctaaatagatttctgctaaaatcctctccctcctgtcttttttaagttatggaaaaacacaactaaattcatttgatcatcagcacttgttagcaggatttccttttttacctttgccttgtttctttagcccacaaatagtactcagcatactttcattaaaaatttggcacaatatgataattgttaatattctgttcttcgtctgtgttttatttaacttttactagtgtttagaagtgcaagaatattaaatagccccttccttaactgtacatattatcttgaatgtagataaaatgaaaatactgtaaattagagtgtaggaaaactggcatagagttaatatattttaatgggtttacattatactttaaaagtaatttatataattaaaatatttggttttaactctatgggctattctttggttggctgaagagggaatgggtctagtaaggtttggaaagttaagctttgaacatggtctttgtgtttttttcctaacaaggaaaggtttagttcagctgtgctattttagtacacatcagttctcttgatttatggaagattcagtttatcaattaagaattcctgcagaagcacagaatcataccatgtaagagttggaaggaagcttaagagatttctgttcgaatctctttgtttcaaagatgaaactaaagcacagcatgttaaatgacttgtctaagttatagctagttagtagtaaataaactgaaaacctatatgctactgtagtccaaaattttattatgtcctcttaatctttacatttagtgagtcagtaaggaaatctctgcatatttctcattctctttgaaagaggaaaaaaacttctaagagagctacaactctatcactcatgacagagttgcttgtagaaaataactaattccttcagaaccctgagtgaattttttctaagaaatgtgacttgattaaaatggtttcaaaagagcaatagtggaaattaaagttttagaaaagagacctggcgtggtggttgacaactgtaatcccagtgctttgggaggctgaggccagaggatcacttgaggccaggagttcaagaccagcctggacaacatagcaagacccccctctctacaaaaaaaatttttttctgaaaagaataagtacattttagagtccatttatttgacgacaggcagtatgacaggttgctgaggtatataaaattttctagagaaatgctgagtttgatgacattttatcttcagttttgtagaacagatgttaaaatgttaactctcctggtgtgcagaaagctgtaatcatgacagttgataatatgcaatttagtttgattttataggtttaattataaaaggcttcacaatatgcatgttttaggaaaatgttcatttatttagtcatataatcgtttgtatatatgtaaataactttattctggaataatgtgggtgccatcttgagcgtgtgtttttatctgttttggattattttttgtatacaaacaccataatactgtattttcctgttatctacttaagtctagttctactttttcccaataatttcaggaaaatacaagcttgagatattatactatctcccttggtattttttgtgtgcaaagtcttagaattggatttataacattgataataaaaatataaaacgtttttcctcgggagttaagatggtaaaaagaaaaaaatagaatgaatatgatcatttctccatcataaaggaaagaagagacttcattgtgtgtgtgttttttttttttttttcgagatagagtttcactgttgtcacccaggctggtctcagctcactgcaacctccacttcctgggtacaagcgattctcctgcctcagcttcctgtgtagctgggattacaggtgtgcaaccacaaggctcggctaatttttttgtatttttagtagagatggggtttcaccatgttggccaggctggtctcgaactcctgacctcaagtgatccacccacctcggcctcgcaaagtgctgagattacaggtgtgagccactgtgcccagccgagacttcattgtttaatgtatatttttattttttccaaacaccagctcgaatcagagtatatttttattttgccacatacctttaaaaggtatttattgtgtcataatgttttaaatgttaaatatatgataccctcattcatgaagtgaagcagaaagggtctgtaaggaacattctaaacatttttaatgatattgcttttactgatcaagcttgttgtgccatattaaaattaaaagtcaaataaacaaagcagtcctcacagccttggaaagaaatagataattgtcttcttaagatgaggtgctttttatctgtggatgaatggaaatcacactgaattttaattcttatttattttagtggatagcaggaatcactctgtagtagttgtgttcattttcttttctttttcttttcttttttttgagagagtctcgctctgtcaccaggctggagtgcagtggcgtgatctcggctcactgcaacctccatctcctgggttcaagtgattctcctgcctcatcctcccgagtagctaagactacaggcacacgccaccatgcccagctaatttttatatttttagtagagatggggtttcaccatgttggccaggatggtctcaatctcttgacctcgtgatccacccagtttggcctcccaaagtgctgggattacaggcgtgagccactacacctggccttgttcatcttctaattaaatatctttgaatgttttgtaataattttaatgttgacaataagagtttaaaaataatttgattttggactgtatttagatttctctttaattttgctgtagaaatagtaaatgatttaaagtggttatgatgtgttttatgaaggcttactattttatattgtacttatttaatttgtatttgagtctgtctaattttaaataaaaggtttatacatttga

SEQ ID NO: 1215 - DNA, 4992 bp, Homo sapiens
agccgcgatgccgcgatggagcgcagcccgggcgggcgccggggccggggcccgagcgccaggcggagcgcgagctggagccgcagccggagcccgggccaggccgggggccgggagcgcagggccgggctgctcgtagcggcggcgaccgagccccccagcggctgaggggcttccagcgcccgccggtggccgggacccactaaagcccccgcagccgaggagtgcggggagcccccttccacatccaggatccggcgagcctcggggaagagggggggccctcccggatccgacaccgagcgactcccctgcggggaaagcggagacttcctcggtatttagaagacagcaagccccctacggcaccgcaaggactccccctcctcagtctgggcccccgccccaagacctagaacgcagtgcccccaggccgggattgcgagaaccccctcccaagatccggtcattacaactccacacctcaagacaagaagacccagctcagaacgcccctagatcaggggatcccaattccccccaactccggtacatagaaatcccaaatctaggcagccggggacagcaagagacactctcaccagcaagaagcctcggggatcccccccctaaagctccaggacttgggcgactgagcccctggcggcaccgcttgcaccccggtccatggtcgtggcgccctgagcccccggggccgggcagacgaagaccgcgacggcgcccaggccccctgccgcggcgtccccgcggccccagcccagggagaagatgagcgtgggctgcccagagcctgagccgccccgctccctgacctgctgtgggccggggactgcccctgggcctggtgccggtgtgccccttctcactgaagacatgcaggccctgactctccgcacactggccgccagcgacgtcaccaagcactacgaactagtccgggagctgggcaaaggcacctatgggaaggttgacctggtggtctacaagggcacaggcacaaaaatggcactgaagtttgtgaacaagagcaaaaccaagctgaagaacttcctacgggaggtgagcatcaccaacagcctctcctccagccccttcatcatcaaggtctttgacgtggtctttgagacagaggactgctacgtctttgcccaggagtacgcacctgctggggacctgtttgacatcatccctccccaggtggggctccctgaggacacggtgaagcgctgtgtgcagcagctgggcctggcgctggacttcatgcacgggcggcagctggtgcaccgcgacatcaagcccgagaacgtgctgctgttcgaccgcgagtgccgccgcgtaaagctggccgacttcggcatgacgcgccgcgtgggctgccgcgtcaagcgcgtgagcggcaccatcccttacacggcgcctgaggtgtgccaggcgggccgcgccgacgggctggcggtggacacgggcgtggacgtgtgggccttcggcgtgctcatcttctgcgtgctcaccggcaacttcccgtgggaggcggcgtcgggcgccgacgccttcttcgaggagttcgtgcgctggcagcggggccgcctgccggggctgccttcgcagtggcgccgcttcaccgagcccgcgctgcgcatgttccagcgcttactggccctggagcccgagcgccgcggcccagccaaggaggtgttccgcttcctcaagcacgagctcacgtccgagctgcgccgccggccctcgcaccgcgcgcgcaagccccccggggaccgcccgcccgccgccgggccactgcgcctcgaggcgcctgggccgctcaagcggacggtgctgaccgagagcggcagcggctcccggcccgcgccccccgccgtcgggtcggtgcccttgcccgtgccggtgccggtgccagtgcccgtgccggtgcctgtgcccgagcccggcctagctccccaggggccccccggccggaccgacggccgcgcggacaagagcaaagggcaggtggtgctggccacggccatcgagatctgcgtctgagtcgcctccgccgccctcggacccgggagcagcccgggcccgccccgagccggtgcccggtgcggcggtagggaatggagccacctcgccgcggggcagggggcgcagcggtagactaggcaggacgcggcccggcacctggtccgtccccggcgggctggtgagggggccaccaaagacccctagcgcggcctggtgagcgggggcttggcccagaggagccaagccgcacagacccgagaattcggaggccaccacacaacacacacacacacacacacacacacacacacacacacacacacacacacacacacgccaggagcaagggagctttcgggccacactcccagacgcctccctgagccctggaacccggactcgttgctcctggccttccataccccctggcagatcatcctgcggtcccaccccagatcccctcctcctcgccatcccattctgccccctccccaccctgggtacagaaagggactgaagtgttgggcagagagggggcttaaggcccctgggcacaggctgggatcagggcagtgagcgaagggcagctgtgtcctgccctcccttctggaggctggaggggagaggccaagcccttggaaaatgtagcaaatgtctggatgtcgcataagtgcgtgtatgtgcgggacaggccccgagaagctagtgactcctgcacacccccattgcacaaatgaaatcacagcccaggagggagggtagcttggcactggctgagaaatagagctctctccccgcccctccccctaaccacaagggattgtcctgacaacttgtggggatagaagggctcacagggcaggggtctcagctgcccccatccttagggcaggggagttagtgtggagccgagagcaggtcccagctccccctgccagccgcactgtcccaggcccagggacctctgccgggtcctcccagcccttgccacacagcctagacgtagtagcctgggcttccagcaggtggcgagctggttcgtgctggaaatttctcctgggtttcttggggtcaaacatgccaacctccaagaccccatcctcacgtctcccacttttctggcgctggagtgtgcagggcgtaggacctgcatgtgtgggtgtgagaatgggggcggtggacaccagggggcgagtgtgtgactaggtgtgtgtgcacatgtgtagggtgcagacgcatgggtgccatcctttgcgttcagtgactgtgcgtccagacccctcaccagcggcccccccaccacaccctggtcctcccaggcagctgtcccagggcgcccaggcctgccttgcaccacagccctcaggaaatccggcaaggaggcccctgcaggttggttcaggcccccaggtagcaaaacagagacaacagcagccccgcctgaccccctgcccctctctgtggaggcccgggacccccgcaataagcaccacatgggtgaggctgtccctgtcagggtcccctgccagggtccctcctggggttctgggccatttgaggggctctttgatgggccaggccggccagagtgaactccgagcactttctggctggtgccccaacctctccactccccactcattcccaccttgaaaaagggctataggtcccctgccctgcccgggtccagtttacaaacagtgtggggtggccccagggcctggccccactctccctgctgtgcccactcctctccagactccacctccccagtgggtatgggccctccacatgccaggtaagtagcaaacccccactccctccaaggaccaggtctcagagaaggccctggtcactgcccccggcccacctggagcccatcggggctgcctctcccagccgcgacttctccttttgccttaggcctcgcgacatcctgatctctcctgcaataactaggaatcgagattccacagtagacgtcccttgccgtgctcgctctctctctcgcgcgcgctctctctctccctctctctctctctctctctctctctctctctctctctctctctctctcctctctttctctctctccctctctctgttaagatcctgttcgggagtttccccagccgttgtagtatctagtatgttagagttgggaggggaccatagttatgtagcccagccccctcattcccagaggcacccagagggccagcctccagcctgaccccagagcagaaccggaacaccaggttggggccctggtgctgccacctcctctgctggtcgggctgggaccctttgccccttaggagaggtgttggtcacagatgtttacctcagtttatgtcactgtcgaagaaacaaaaaataatagcaaaaaataacactgtagacatgaagacttagaagacaaaaaaaaaaaaatcacacaaaaaatctcccttgttgcgattcttctgtgaaggtacagtgtgtatgtgtgtatgtgtgtatgtgtgtgcgtgtctctgtcccagaccctgtgtcccccacactgccccctgtccttcggtgcttcccagagacccctctgagctggcctgtggggcacgggaagccccctggatgggaggcggggccacaggtcggctagagggtctccaccaggcccactgaacagaaccccacggctgccagaatgttccctgagcccacactgtggccagtgggacagtcctggtggctgacatcagcgtccatgcttggctcagggcctggggcggggtcctgggtagagtcctagccccagagccccagcccctcatgtcttgccgcccttcctccatgtgtttgtaaatactctggcatcctttggccctgagaaggtttttaaatgtgttatttacttctctaaacatgacgattgctataaaaataaacaaaagtttagaaaaatga

SEQ ID NO: 1216 - DNA, 1739 bp, Homo sapiens
ggtcaccatggcgaccaggcgccttggggtcggggagacgctgggggccctcaacgcggccctggggccaggcggtccggtgtggatcaaggagacgcgcacccgccacctgcgttcccgagactttctggcaccgcaccgcgcgctgcaggcgcgcttcgatgacggccaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacggggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctatgaccccaacctggacaactgtctggtgactgaggatctcctctctgtgctggctgagctgcaagaggctctatggcattggcccgaggacagccacccaggcctggctggggcctcagatactggtacaggcggctgcctggttgtacatgttgttagctgtgaggaggagttccagcaacagaagttggacctgctttggcagaagttggttgacaaggctccactcagacagaagcacctcatctgtggccctgtgaaagtagctggtgcacctggcactctgatgactgcccctgagtactacgagttccggcatacccaggtgtgcaaggcctcagcactgaagcatggtggggatctggcacaagacccagcctggacagagatctttggtgttctctctgtggccaccatcaagtttgagatgctgagcacagccccacagagtcagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgagggtgagtggttgttgctcttcaacagtatcctcccctttccggatctgctgagccggacagcagtgctggactgcacagccccggggctccacattgctgtacgcacagagatgatatgcaagttcctggtacagctcagcatggatttcagctcctactacaaccgggtacacatcctgggggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgttacaaa

SEQ ID NO: 1217 - DNA, 1921 bp, Homo sapiens
cttgctgctggaaacgcagttccggttaggcggctgagtttgtttacgttgctaacagatctagcccctgctttccctagttccagttccaagatggggaaatccttcgccaacttcatgtgcaagaaagactttcatcctgcctccaaatccaatatcaaaaaagtatggatggcagaacagaaaatatcatatgataagaagaaacaagaagaattgatgcagcaatatcttaaagaacaagaatcatatgataatagattgcttatgggagatgaacgtgtaaagaatggccttaatttcatgtatgaagccccaccaggagctaaaaaagaaaacaaagagaaagaagaaacagaaggagagaccgaatacaaatttgaatggcagaaaggagccccacgagaaaaatatgccaaagatgacatgaacatcagagatcagccctttggtattcaggttcgaaatgtgaggtgcattaaatgtcacaaatggggtcatgtcaacacagatcgagaatgtcctttgtttggtctttctggaatcaatgcaagttcggttcccactgatggctcagggccatcgatgcacccctcggagctaatagcggagatgagaaacagtgggtttgcactgaaacgaaatgtactggggagaaacttgaccgcaaatgatccatcacaggagtatgttgcaagtgagggtgaagaagatccagaagttgaatttttaaagtcactaacaaccaaacaaaaacagaaacttctcaggaaattagatcgactggagaagaaaaaaaagaaaaaagatagaaaaaagaaaaagtttcagaagagcagaagtaaacacaaaaaacataagtcctcttcttcctcatcttcctcctcctcctcctcttcctctactgagacttcagaaagcagtagtgagagtgagagtaacaataaagaaaaaaaaatacaaaggaagaaaagaaagaaaaacaagtgttcagggcataacaacagtgattctgaagagaaggacaagtctaagaagagaaagcttcatgaagaactttctagcagtcaccataaccgggaaaaagccaaggaaaagcccaggttcttaaaacacgagagttctagggaggacagcaaatggagccattctgattctgacaaaaagtccagaacccataaacatagcccagagaagagaggctctgaaagaaaggaggggagcagcagaagccacggcagggaggaaaggagccggagaagccggagcagaagtcctggtagttacaagcaaagggagacaaggaaacgggcacagcgaaatcctggtgaagagcaaagcagaagaaatgacagcagaagccatggcacagacttgtatagaggagaaaaaatgtacagagagcacccaggaggtacacatactaaagtgacacaaagagaatgaagcagaagtagagaagaaagactgtatgtgacaattacctgggaataaaaatatctccacttttttattgaatacctttagcaaggggtaaattatgtactgttgtctttctaataaaaaagctcaattttaatttttcatctctagactgtcaattcaagtacaaaactacatgagtactataagaatgaattttgcaaatatttgtaagtaagctattttggggctgtggaaatattttctgttggtaactgtttcttgttccccataccagataaaaaccgcatataactctgtgacattttctttgttctgaaacatcattaaaagaatgacagtacattgaatgggtataatttacttttttcaattcaaatttgttattctaggatttgaatttgcttgaagtgaattgtaataattattcaaattcattagtataaattaaggattaataaatctttaagacttttaa

SEQ ID NO: 1218 - DNA, 1681 bp, Homo sapiens
gggtacctgtaccccacgtagtcgccggttaccgatcggactaagttccagaagcaagagataaagtaataatgggtactgtggggaaaaacacagaagaacaattcggtaatatagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 1219 - DNA, 2959 bp, Homo sapiens
gggtgacgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacgccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcgggctatggagctggtgctgtccgccctgctccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 1220 - DNA, 6472 bp, Homo sapiens
aggggcggaggtgacagcgggctggggactggcggctgcaactgcctgccgcgccgagggaccgccgggcggcggaaagcaggttataaaacatggaggctggctcagtggttcgagccatttttgacttctgccctagcgtatcagaagaactgccgctctttgtgggagatattattgaggtgctggcagtggtggatgaattttggcttctaggaaagaaggaggatgttacaggacaattccccagcagttttgtggaaattgtgaccattcccagtctaaaagagggagagaggctgtttgtgtgcatttgtgaattcacatcccaagagttggataatcttcccctccatcgaggtgacctggtgattctcgatggcattcccactgcaggctggctgcagggccgaagctgctggggcgcacggggcttcttcccatcttcatgtgtccgcgagctctgcctctcctcacagagccggcagtggcactcccagagcgccctgtttcagattccggaatattccatgggacaagcccgggccctaatggggctttctgctcagctggatgaagagctggacttcagggaaggggatgtgatcaccattattggagttcctgaaccaggctggtttgaaggggagttagagggccgaagaggcatttttccagaaggttttgtagagctgttggggcccctgaggactgtggatgagtcagtaagttctggaaatcaagatgactgcattgttaatggtgaagtagatacccctgtaggagaagaagagatagggccggatgaggatgaggaggagccagggacctatggggtcgccctgtacagattccaagccctggagccaaatgagctggatttcgaggtcggggataaaatccgaattctggcgaccttggaagatggctggctggaaggatccctgaagggcaggacaggcatctttccttaccggtttgtgaaattatgtcctgacacacgggtggaggaaaccatggctctgccccaggaaggcagccttgccaggatcccggaaacttctttggattgtttggagaacaccttaggagtagaggaacaaagacatgaaaccagtgaccatgaggccgaggagcctgactgcattatttctgaagcacccacttctcccctcggtcatctgacttcagagtatgacacagacagaaactcttatcaggacgaggacaccgcaggagggcccccgagaagcccaggcgtggagtgggaaatgcctcttgccacagactctcccacatctgaccctacagaagtagtcaatggtatttcctcccaacctcaggtcccttttcatcccaacttgcagaaaagccagtattattctacagtgggagggagccacccgcactcagaacagtaccccgaccttcttcccctagaagcaaggactagagactatgccagcctacctcccaaaagaatgtattcccagctaaaaactcttcagaagccagtgctccctctttacaggggctcttctgtttcagcttcaagggtagtcaaacccagacaatcaagtcctcagctccacaacctagcaagttatactaaaaagcaccacacgtccagtgtttactccatctcagagagattggagatgaagcctggtccgcaagcccaagggcttgttatggaagcagcaacacattcacagggagacggcagcactgacctggactcgaagctgacacaacagctgatcgagtttgagaagagcttggcagggcccggcacagagccagataaaattttacgccacttttcaatcatggactttaactctgagaaggatattgtccgaggttcctcaaagttaatcaccgagcaggagctgccggaaaggagaaaggccctaaggccaccgccacctcgtccctgtactccggtatccacttctccccatttgctggttgaccagaacctaaaacctgcaccacccttggtggtgcgaccctctcgcccagctcccctgcctccctcagcacagcagagaacgaatgcggtatcccccaagctcctatctcgacaccgtcctacctgtgagaccttagaaaaggagggccctggtcatatgggaaggagtctggaccagacctccccatgccccttagtgctggtgaggattgaggaaatggagcgggacttggatatgtacagtagagctcaagaagagctaaacctcatgctggaggagaagcaggatgaatcatcaagagcagagaccctcgaggatctcaagttctgtgaaagtaacattgaaagtttgaatatggaactccagcaactaagagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctgggtaagaacagcataattgctgaaaaggagtatgcccatgctgaggaaagtgcttttctgacttactccctagtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccagcacatccgggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttcctccaagtgcacatttagccttaaaatcctgggagtcgggagacaccgtggagtcctaacatccacagtgtctgctggtcgtggtcagaaggcagtaatgcaagagtccttttgtgaagagtgtttctatgtagagatgtttatatttaagtagttcttttataaataaaagcatttctaatggc

SEQ ID NO: 1221 - DNA, 2309 bp, Homo sapiens
gcgctcccgcttgccgcagcctgcgtcgtctgccgccaccgcgcgccttcactgacctacaccaccgccgccgccgccgccgccgccgggctcgctggctggcccggtgcgggcggcggactcccgccggagaggactgccagcgccgccgccgccgccgcttcggcccgggcccgggccccgaccccgtcccgggccccagcgccggccgcccgcccggtcgggcgatgaagtgtcactatgaggcgctgggggtgcggcgcgacgccagcgaggaggagctcaagaaggcctatcggaagctggccctgaaatggcacccggataaaaatctggataatgccgcagaagcagctgaacaatttaaattaatccaagcagcatatgatgtgttgagtgaccctcaggaaagagcatggtatgataatcatagagaggccctacttaaaggtgggtttgatggcgaatatcaagatgacagcttagatttgctacgctatttcaccgttacctgttattctggttatggagatgatgaaaagggattttacacggtgtatcgtaatgtttttgaaatgattgccaaggaagaactagaatctgtgttagaggaagaggttgatgatttcccaacttttggagactcccagagtgactatgatacggtagtccatcctttctacgcttattggcagagtttctgcactcaaaagaattttgcatggaaggaagaatatgatacacgacaggcttcaaaccgctgggaaaaacgagccatggaaaaagaaaacaaaaagattcgggacaaagcaaggaaagagaagaatgagcttgtccgtcagctggtagctttcattcgtaaaagagataaaagagtgcaggcgcatcgaaaacttgtggaagaacagaatgcagagaaggcgaggaaagccgaagagatgaggcggcagcagaagctaaagcaggccaaactggtggagcagtacagagaacagagctggatgactatggccaatttggagaaagagctccaggagatggaggcacggtacgagaaggagtttggagatggatcggatgaaaatgaaatggaagaacatgaactcaaagatgaggaggatggtaaagacagtgatgaggccgaggacgctgagctctatgatgacctttactgcccagcatgtgacaaatcgttcaagacagaaaaggccatgaagaatcacgagaagtcaaagaagcatcgggaaatggtggccttgctaaaacaacagctggaggaggaagaagaaaatttttcaagacctcaaattgatgaaaatccattagatgacaattctgaggaagaaatggaagatgcaccaaaacaaaagctttctaaaaaacagaagaaaaagaaacagaaaccagcacagaattatgatgacaatttcaatgtaaatggacctggagaaggagtaaaggttgatccagaagatactaacttaaatcaagacagtgccaaagaattggaagatagtccccaggaaaatgtcagtgtcacagagatcattaaaccatgtgatgatccaaaaagtgaagctaaaagtgttcctaaacccaaaggaaagaaaaccaaagatatgaaaaaacctgtcagagtacctgctgaaccacaaacaatgagtgttcttatcagctgtacaacctgccatagtgaatttccatctcggaataaactttttgaccatctaaaggccacaggtcatgcaagagcaccttcatcatcgtctttaaacagcgcaacaagtagtcaaagcaagaaagagaaacgtaaaaacagatagagattctgcctgtgcttttgtttgactgtctctagattttgaaaccaaaaaactgaactgaaatcatctaaagagttaaaatttcagtgatctgcaattaattacattgtggaagattattttttatcttgtaaaaacacttttttggtttaatatatatttttaaaacatttcactagtgattgaattctacttttgccatctgaattgacttgaatgtcttaaaacaggtaaatactgtaaagtgtgtattcttgatgtttattggctcatgtggacagaaatgtacagggagaattacattattttaacacacagaagtgcaactttctgctttattttctgaatttcacattacttttacttaatgcttttgtgttttgttaatacttcataatatgtgaaaaactcggatcttttaaaaagcatcatagatcatttttccatatgacactggttccgattttaaaaattatttttaaataa

SEQ ID NO: 1222 - DNA, 1741 bp, Homo sapiens
tctgcagccacgagaagcaaagttgacatttctggatcactctccccagacgcgtcacttgcccacaagcgggacacggcagtctcgctgagccagctgtgcagagggacagatggaagaaagctagagatgctgcttcgtgggcgctgaagttgcagaacttgggctggttttctttcttcccatcccccctcctcctgacaaaccacatcttgactcagatggtcgaaagaaaaactctttcagttatttgatatttgggaaccctccaggagaccataacttatttttgagggaggctccttctctccctttgctgggaacacacacacacacacacacacacacacacacacacacacacacacacagctgtacaccatggtggttcaggctgcagtggctccgaatagatcccaaagacttttactgaaaattccttatggatctctgagaaggcgcagcgttgaaaggatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggtaggcagaggccagctggagggacgccccctgagcatggctgggaccccagaggggacccaggaaggtggggagagctgcagctggggagactgcagggcaagctgctccaaagctggctttgctttccagaccaaggttgggatccaaatgcgaatctgagaaaactgctcccaggaatcaaatagtggaagg

SEQ ID NO: 1223 - DNA, 4064 bp, Homo sapiens
gaggcctgcgcgtgcggtctgcagttcggccgcttcctcttggcgggtgggctgcagctatggagggcgagcctccacctgtggaggagcggcggcggctgcaggaggagctgaacgagttcgtggagagcggctgccggacgttggaggaggtgaccgcgtccctgggctgggacctagatagtctggatcccggggaagaggaggcggcggaggatgaagttgtgatatgtccatacgattccaatcatcacatgcctaaatcatctttggcaaagcacatggcatcttgtagattgaggaaaatgggctataccaaagaagaagaggatgaaatgtataatcctgagtttttctatgaaaatgtgaagataccttcgattactttgaataaggactcacaattccagataattaaacaagctagaactgcagttgggaaagacagtgattgttataatcaaagaatttattcttcattgcctgttgaagttcctttgaatcacaaacggtttgtttgtgatctaactcaagctgatcgtcttgccctctatgatttcgtagttgaggagacaaagaaaaagcgctctgattctcaaattattgaaaatgacagcgatctctttgtagacttggctgccaaaatcaatcaagacaatagtcgaaaaagtccaaaatcctaccttgaaatcctggcagaagtacgagattataaaagaagacgccagtcctatagagccaagaatgttcacataaccaagaaatcatatactgaggtgattcgagatgtgataaatgtgcacatggaagaactcagcaatcattggcaagaagagcaagagaaggcagaggatgatgccgaaaagaatgaagaaaggcgatcagcttcagtagattcacggcagtctggtggaagctatttggatgctgagtgttcacgacatagaagggataggagtagaagcccacataaaagaaaaagaaacaaagataaggataaaaactgtgagtcgagaagaaggaaagagagggatggggaaagacaccatagtcataaaagaagaaagcaaaaaatataaatgaagtacttgtacctatattaattatgcttacgccatgataaccaatatacagatatattaattggaattcctttgcataggagaatgtttttatgatctgtttagtgcttattattttttttatgatctgtttagtgcttattattttccagtaaatatgcttcaaaccatgagtacactattaggccctacaactttgttttccttatattttattagatgatttgcttcctataactgatgttgttttgttcgttttgctaatatatgtatctcaaaattctttaagtcaatatttatcatatgtaaattaaacatgaatacattctcatcttataactacatcttataaataaggctaataacccttagaacaccacctgcggttctgtcctcaccccagtggtgactactgtttaccactacactggtgaattgtagtagggaaaaacaatctaaatattgaagaggaatggcctaattaaaatatgatgtagtcataggatagattattgtattggagttaaaagaaataatctagatccatattaacctggattggtctcaaaaacataatgctcagtgaaaatagcaagttgtagaaagttatatacaaattatatatatgtacaaaacaatactatgcattctctatggctatataatgtacgtaaatctatttttaaaggttcagaggaatccataccaaagttctaacagcgagtaggaggtatagatgagagattaggggtgcaaatcaggattgggagggtggtcagagggaactttagctttatccataacattaatttttttaaaaaataaggtcttaatgtttcatttaatttaaaatatactgtcatgttgtgttttgtaaatcaactgaattgaggtactatttacttagatttattgcaccctttttacgtgtgtattttattgggttttgacagattcatacctctgtgcagccactatcacgatcaagatacaaatattttcattgcccccaaaattctcataccccctttcccaatcaattcctctacccctagccctaggcagccacagatttgcttttggttaccgattagatctatccattgtagaattcatgtaaatagaatactgtagtatgtactttgccttcttcctctctgcagatttttgagattgatccctgtgtgtcagttgtgcattttttttgttgctgagtagtatgttctatcttatgtcagatcattcacgtgagactttggcatgaaatgttaagcatccgacatctaaatagcaatattttgaatactggaaactcaggttaaagattttgtttccaagtagaaatgaaatcttattattttaataagtagctgacagtgacagaaagattggatttggatcagattggctgttaggcttcaggtatgggaaacagctctcagatttataaattggaaatcaccaggttacttgccaatatatagtcatattgctgccattgtacttaatttctaaatatataaaatccacatttaaaaattataaaagcaaggacttgggagtgactgatgaatcatgaaattgctgcttttatagatcaaaactacttgaatcatcaggaatttcatatttttcatattgtgtgacaacttataattttgtttcaaattgtgatttcattgattttactaactggaaggaagaagagtaaaattggcatatttaggttttttgtagaagaaagatacaagtgaaaattaggagtggattggagaaattggggggaaatagaagagtacggagaaaggaagagattgaaaatgttaccagagttctttaaagctcacattttatagtatcactgctacaaactatttaatgaaatgtggcatcgggtgaaaagaggcatttgtttgatccttgaacgaattaatctcacgtacttccctgtttgtggtttgagcctttcactggatgtgagctacttgagagcagggtttatgccttcatcagcgtgacccctgtgcctgcagcctcataggtgttaatctgtaattttaaattttgacaaaagcattttcacagccctgccacataagatctagtttttatttctagagtgctgctatgaataattactatagctgctgtccatcttgcccatccattaaggtaccttctcacaaacatttctaatctactggctggagtgcagtggtgcagtctgtagctcactgcagcctcaaactcctaggctcaggcgatcctcttgccctggcctcccatgtagctgcaactataggtgtgtgccactacacctggctaatgtttttagttttttagagatggagtcttgctctgttgcctaggctggtcttgaactcctgggctcagatgatcctcctgtcctcagcctcccaaaatgctgggagccaccaggcaccaggtgtgatctaccacacctgtctaaaaagtatgtatttttaaatttttttgtagagacaggatctcactatgttctccagctggtctcaagctcctggcctcggcctcctaaagtgctgggattacaagtgtgagccactgtgcctagtcactttaattgagatattggcaagtcaactgccatgcagagcccagggcactggttatattcagtaggaaactgaactcagcactcagaattttaaattaaatcaatgatcttcaagtatttgccactttcgagtacagctaattggataatctcaaaccctttagtgaaaatatcttaaatgcattgagaatattttctaattacctgtgtatgctacagtacagacattaattctataaacatgttcataggtcttccccctcgccccgcccgtcttctaagggcattttctgtttctttttagtgagttcatgaatgtttaacggttctggcgcaaagctttcttgcattctgagcataaaaataataaaacccacttatatttg

SEQ ID NO: 1224 - DNA, 12929 bp, Homo sapiens
cgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaagactgcaggcacacagtttggaagggctctgcctttgctgctcttcatagaggaagacctcctgaaatgccagtgaattatggttccccaccaaatcttgtggagatacatcgaggaaaacaactcacagggtgttccacttttagtacagcatttccaggaactatgtatcagcatataaaaatgcacagaaggattctcggacatctatctgctgtttactgtgtagcatttgataggacaggacatagaatctttacaggttcagatgactgtttggtaaagatttggtcaacacataatggccgcttgttatctacattaagaggtcattctgcagaaatttcagatatggcagtaaactatgagaatacaatgattgctgcggggagctgtgataaaattattagagtgtggtgcttgagaacttgtgccccagttgctgtgctccaaggacacacaggatcaattacatctttacagtttagcccgatggccaaaggctctcaaagatacatggtttccactggtgctgatgggacagtttgcttttggcaatgggatttagaatccttaaaatttagcccacgtcccctgaagttcactgaaaagcctaggccaggcgttcaaatgctttgttcttcttttagtgttggtggtatgtttttagccacaggtagtactgatcatgtaatcagaatgtattttttgggttttgaagcacccgaaaaaatcgcagaacttgaaagccacactgataaagtagatagtatccaattttgtaacaatggtgatcggttcctaagtggtagcagagatggaacagcacggatttggagatttgagcagttagaatggaggagcattttattggatatggctaccagaatctcaggggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatgggacatgctgatgaagtatttgttctggagacacatccctttgattccagaattatgttatctgcaggacatgatggcagcatatttatatgggatattacaaaaggtaccaagatgaaacattattttaatatgattgaaggacaaggacatggagctgtgtttgactgtaagttttcacaggatggacagcattttgcctgtacagattctcatgggcaccttctgatatttggttttggatgcagcaaaccatatgaaaagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaccactaggcatatttaggaagctggaagacttccgattagagaaaggtgaagaggaaagaaatctttatataataggaagaaaaagaaagactcttcagctctcacataagtcggattcagtggttttggtatcacagtctagacaaaggacatgtaggcgtaaatatccaaattatggtagaagaaatcgtagctggcgtgagttatcttctggaaatgagtcttcaagctctgtaagacatgagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaagaacatcatgtcgtcgacgaattactcgattttgtagtagttcagaagatgaaatatctactgagaatttatctcctccaaaaagaagacgaaagagaaagaaagaaaataagcctaagaaggagaatttgcggaggatgactccagcagagcttgcaaatatggagcatttatatgaatttcaccctccagtttggattactgacaccacacttagaaaatctccttttgttcctcaaatgggtgatgaggtaatatattttcgacagggtcatgaagcttatattgaggctgtaagaagaaataatatttatgaactgaaccctaataaggagccatggagaaaaatggatcttagggatcaagaattggttaaaatagttggaatacgatatgaagttgggccccctacactctgttgcctaaaactagcatttatagatccagcaactggaaaacttatggacaaatctttctctattagatatcatgatatgccagatgttattgactttcttgtattgcgtcaattttatgatgaagcaagacagaggaattggcagtcttgtgacagattccgctctattattgatgatgcttggtggtttggaacagtgttaagtcaagagccatatcaaccacagtatcctgatagtcatttccagtgttatattgttaggtgggataatactgaaattgaaaaacttagcccatgggacatggaaccaattcctgataatgttgatccacctgaagaattaggagctagtatttctgtcacaacagatgagctagagaaattgctctataaaccacaagctggtgaatggggtcagaaatcaagagatgaagaatgtgatagaattatcagtggtatagatcaacttttgaatcttgatatagcagcagcttttgcaggccctgttgatttgtgtacatacccgaagtactgtactgtagtagcttatccaaccgatctttacacaattcgaatgagacttgttaatcgattttacaggaggctgtctgcgttagtttgggaagtcagatatatagaacataatgccagaacatttaacgaacctgagagtgtaattgcaagatcagctaaaaagataactgaccaacttttaaaatttatcaagaatcaacactgtacaaatatctcagaactttctaacacatctgaaaatgatgagcaaaatgctgaggatttggatgatagtgatcttcctaaaacatcttctggaaggaggagagtccatgatgggaaaaaaagcatcagagctacgaactatgttgaaagcaactggaagaaacagtgtaaggaactagtgaacttaatttttcagtgtgaagattctgaaccatttagacaacctgttgatttggttgaatatccagactacagagatattatagataccccaatggattttggaacagtaagggaaactctagatgcgggaaattatgacagccctttggagttttgcaaagacatccggctgatatttagcaatgcaaaagcgtatacaccaaacaaaagatcaaagatttatagtatgaccttgagattatctgccttatttgaagaaaaaatgaagaaaatctcttctgattttaaaattggtcaaaaattcaatgaaaaacttcgaagaagccagaggttcaagcaacggcaaaattgtaaaggtgacagtcagcctaacaaaagtatcagaaacctcaagccgaagaggttaaaatctcagacaaaaataattcctgagttggtaggttctcctacccagtctacctcaagtaggacagcttatcttggaacccacaagacaagtgctggtatctcttcaggtgttacttctggtgactcttcagattcagcagaatcatcagaaaggaggaaaagaaatagacctataacaaatggttctacattatctgaaagtgaagtggaagattctttagctacctctttgtcatcgtcagcttccagtagttctgaggaaagcaaagagagttccagagctcgtgaatcctcctcacgcagtgggctatccagaagcagcaatctcagggtaaccagaactagagctgctcaaagaaaaactggtcccgtttcattagcaaatggatgtggcagaaaagccactcgaaagagagtctatttaagtgattctgataacaattcattggagactggtgaaattctaaaagccagagctggaaataaccgaaaagtcttaaggaagtgtgctgctgtggctgccaataaaataaagctaatgagtgatgtagaagagaattctagctctgaaagtgtctgttctggtcggaagctgcctcaccgcaatgcttctgctgtagctagaaaaaagttattacataattctgaagatgaacagagcttaaagtcagaaattgaagaagaggagctaaaagatgaaaatcaactattaccagtgtccagttctcacactgcccagagcaatgttgatgaatctgaaaacagagactcagagtcagaaagtgatttgcgggtagcccggaaaaattggcatgctaatggttacaagtcccatactccagcaccttcaaagacaaaatttcttaaaatagagtcttctgaggaagactctaaaagtcatgattcagatcatgcatgtaacagaactgctggcccatcaacgtctgtgcagaaacttaaggcagagagcatctcagaggaagcagattctgaaccaggaagatctggtggtaggaaatacaatacatttcacaagaatgcgagtttctttaaaaaaaccaagattctgagtgactcagaagactctgaatctgaagagcaagatagagaagatgggaaatgtcataaaatggaaatgaacccaatttcaggaaatctgaactgtgaccctattgctatgtcccagtgttcctcagatcatggatgtgaaactgatttagattcagatgatgacaaaatagaaaaaccaaacaattttatgaaagattctgcatcacaagacaatggactaagcagaaaaatttccaggaaaagggtctgttccagtgactcagacagtagtttacaggtggttaagaaatcatcaaaagccagaacaggtctcctgaggattactcgaagatgtgcagctacggctgccaataagatcaagctcatgagtgatgtagaagatgtcagtttagaaaatgtgcacactagaagcaaaaatggaaggaaaaaacctctccatcttgcttgtactacagctaagaagaaattgagtgattgtgaaggaagtgtacattgtgaagtaccaagtgaacagtatgcctgtgaaggcaagccacctgatcctgactccgaaggtagtacaaaagtgcttagtcaggctctaaatggagactcagactctgaagatatgttgaattcagaacacaagcacaggcataccaatattcacaaaatagatgcaccttctaaaagaaaaagttcctctgttacatcttcaggagaagattcaaaaagtcatattccagggagtgagactgataggacattttcttcagagtcaaccttggcacaaaaagctactgcagagaataattttgaagtggaactgaattatgggctgcgcaggtggaatggcagaagactcaggacctatggaaaggctccttttagtaagacaaaagtgattcatgattcacaggaaacagcagagaaggaagtaaaaaggaagagatcgcatcctgaattggaaaatgtgaaaatctctgaaacaactgggaattcaaagtttagacctgatactagttccaaatcatcagatttgggatctgtaactgaatcagatattgactgtactgataatacaaaaaccaaaaggaggaaaacgaaaggaaaagcaaaagtagttagaaaaggtaaaacttttacagctaacatatctaaaactgtgagacgtcaaagacaaagcaaacgccctaggttaagtgtggatgataatgactgggaggatttggactatgcaaaatctaaaagagttcttcgacgttcaaaaataaaaacgagaaatcagggtagaaggactgtgagataccatgatggggatgatgacagaagtttagaaaatgtgttagatttcaatggttgcaccttatgaccttgagggaaagccagttcatttaagaggaaatggactggcatttatggtgaaagctggctgttaaaattatttttttgtcttacaattcagggaatatatttatatttttctatgaaaagttatgaatgtgactaaatcatgactgttatttttatttgcacttgctggtctttgtagcagcattcagcacaggtgccaaaatatgcttcattttgggggcagatctattttgacagtatttgactacatatagcaagagtttgaaatatgttaaacactagacatcctggttatcaaaaccaatgagcattactttcatggcagcaagtgtcatgcagttattttctgaatttgtcaaagaggcagtagtttctaacccctgttctatagtagttacaacaatttcacaacctatgtttacagattcttcataaatacatgcatactgacactataatcatgggaggtgtaaccatgattagtaggcgaggtacctaccacttttttttttttcttcccctggctacttgagtagaatgcattataccagatctggtcactttcattgaaatggtttctaattttcttcccaagtgctgttgggtttttttcttcttaaggaaaacgttgtcacttttatgttataaacttgaatttataaagtgctggtaaattatttttaatgatttgagtgcatgttttaaacctctaggaccagagcatagtcagagcattttcttttaaattgtgcactaacaaaatgctatataatctgtcttctgtccaagatctcctggtttccattgtaagggatttaaccaaaatcttgctcttccataatcttactctgtgaaatagaggaattcgtgtgccttagatttagaagtgtgttctttaatagagtgtacagggctaaaagagtatttaagttaatatgtaggtttcccccatctgtattccaattgtagaggtgagttttgttaagagtacaattgcaaatcttatctatataggaaaatagctaaatgtcattctccatctctttgttttagtttactgcttccatgtgcaatcctaagcattctttgctggggcaactaaatgtatctttattagtgacttctagtccaaatataagaaactgtcatgttttgtgggaaaataattttataatccatttaaagtgaaagtttatcacacaaatagtacacttattttctaaccaaatacttgataggttatgctactccagtgtagatggccattcctaacttgtttgtgcctgaagatggacttgattcaaatggtttacatatttagtgggtaagggatatgttacagtaccccacctgtaagttatttattagccctaattgtgtttgatttcagacaaaattaacccttttctcctgtgtatctttgaagtggcagataaggtgaagcatcagactggtatcaatattagacaatgttatttattagccctaattgtgtttggtttcagacaaaaccttttctcctgtgtatctttgaagtggcagacaaggcgaagcatcagactggtattaatgttagagaatgttctgaagtgttcctattttgtagttatctattccatttgacatagtagaaggtacattttctttctactctgatgcatggggaaggatgtttttggacattatcaactgagataggtgggaaacctcctctcatttgtggcttagagagctatcaccatttcagaactatgatgcttttcttctcagaacttgtgttaagtagatagtaaacagattgattcatgataattgtccttgactaagactgaaaagactaatgggatgccttttactttgctaattttaaaaactggtgatagatgtcaaatccattaatttatttaaactcttcttaaccttctcttttataatctgttctcaggttttaactccatgtttaccatcatttgcaaaaaggtaccaaaaaaatccataaataaatatggaatacattcataagtacatacattcttttggtataaaacaatattttgacagtttaggcttcattaatagaactattctgattatttggactgcattaattggtcattgactggccatccaattaccattttttctttcagtccaaaatagttagacccttgcatacagaagtggtattttggtttttaatcagatttggtttcatcagaagcagcaagaatggacctgatgtctttaaaagcatagccgacaatggtagcttctcaagttatgaaataaaactgagagataatggagaaaataatttttatgggtttttttggttatggtgctattcctaaggttaactttgaatatgtgacacacacactcctaagtacctttaaggaaaattaataaatcattaatagttaaaatgtttacattgagcactagaacatgtttggccttttttttctacgttatgcaaaatgcccagggatttaatgcacaggtgtactttaatgtttagggtcagtttgtagtattcttgagaaaaagataaagggttataatttgaatgtgaactgatccagaaataagtgctgtacctttccactgcacttgaagttcaacttaatggtgtatgtgaaaaacaaaaactactttggttgtgtatgtccaaagtcctatggttttattcatttatggttttacaggctttgaagtactcagatttgatttttgctttcttggaaagactcactttaccaagcatataaaggaaaaatgatttcaaacattgacaagatagatgagtgttaacaaagctttcttttttcgtgtcctccttatttaaaaaggtatacttacaatgtgaagtaacttatgaataaaaggaaaagtttatcccatattcaaataattcctaaggtcagcctccctttttgtaagtggcaaatatctgattaaatcatttctcagtttattaatccttggaaacaatgatatagcagttactcacagcttgtaaattacaacagaaaggttcctttcaaatagtagagctgcacctaaagaggaaattgggtttataagaaaatggaggcaaagaacttaagttttaagaaaaagcacttcaaaacagaagggcaaatggaaaaggggaatataaaacaaaccaataaaaataccatctgagggtgttactgtccaaaagtaaagaataagatgcatcactaagccctttgcactcgttatgacctcgtaagtaaaaattatcacttagaataaggggtgcacactacattccctctgtcttctagacttttttttttgtagaagaatcagaaaacaatttactaacctccctgtttgatattaaaaataggaagaattttaatattttctgttagtacaagttgaacttgattgtgccaactgaaaccccagaggtttgtatatcagtagaatgcaagaacattgttaaaggtgcttacgatcttttttgttttcctttccactccattgtatcaattttttgagtaacttttaaatggctagaaaatggtctttttgctttgcccttttaaagctgaaataaccagctccattcttttcatgaatagtaagttgatatatttatttatcaggtatcttgcagttgtcaccaaatactgtagttttcttatgttgtatggaaattatagttcaattattttaatgtgatagagtgcaacaagtcattgtagaacttttcacctgttaatgttgaagttatacctctgaatttctgctgtggatatcaaggaaataataaagcagaaaccccaagaaatttgcaacttaacagtttgagactgtctcttatcctagtatttgggaagagaaggaataaatttgtcaaaactaggtgagaaaatagagcattgtgggaaaaactgagtccaactagattagcaaatgttaattcctagctcaaactgtgaatagtaaggattgaaaagtaaagtatgtaatgctaagggctgtgttgtcttttcttacgattttaagttttaaaggctgttaaattacagagatgttgcccaaggatacatggggattctcaaaagtaagagatttttacctttttcataatctgccaagctggttcctaatatattgttaaattggtagaaaaatatctttaaattggtgtctgctcaagaattgcttttctagatttgatggagggagggggagagtcacatcatttggattctaccaatctgcaggctctatctttggcaacatgtaaataattagactatacatctgtttctcaagtatggcaagaccaatagtttgaatttaattatcaatgctatggtatactttctggtcatattttagttatgtcagttttaaggtaagttttttcatttattaaagcccttaaatgagattttagactgccaaagagaagaggcagtccaattgacctaactgaaatgagatgaccagtatatagagcctagatggactgtagcagctctacccctttgttttacaaggtaaatcattttaaaaattaccttttttgatcagtgggtaaaagttaaagggatctttaatttttgatatattcaagttaattttctaaatgtgaatcagtccttggactgcaactatatattcacctacaaaatcccaatcaaaaaattacatgagcctgtcaagcagatctttagttttccacttcacataagatcgttaatgttctaaattaatctattcatttagatgatttttgtcagttcttaaatgggatataataaatttagcattttcatcttaacaagcaaaagagttaaaaaacaaaacaaaacactactccaagccaaatacattctagctggttaattccagacttgtcccaagtggttccccaacctcttttccactggtaatttcttttcatgcaggcagaatataggggtgcgagcgctgtgagttttacatatgagcttggataggggaactgaagcgagtcaggagccctgctggaaaaggggtttgccattggattgtctgtggcctggtttctttccagtagtacagtaatagggtagattgaaaacaagtatttacttctgattctgcctgcatttagtgtgaaatgctcttaaggtattgcttctaaaaagcaaattaagcagttaagtataaagtccctgaattcatatttcaaaataaggcttttatgagatttttattaaaaattgcaatagccatcacaaatctgagtttttctaggggtgagagaaaactgtattgtgatgagctagattagttgtagttccagaataagaacaaaaattcagagttgtgtggtgcccatcattgagtaaatgaaccctaaaaatgaataagctaatgaactagttcatggaattatttctgatggtcttttgacctgatgctgccatactgcagtgttaccagctccccctagaaaacggaactgtttaaaaacacagcaagttacagaaaccattttattctacagccattggggtacttcagtttatgggatgtttttggaaacttctgctttgggagggatgaagatcattgataaatgttatttgctttctgagttttggggtcatttcattgcttatcaatgaagggcagacagaggagagaatatctcaagtcttttctgataaaaggcttgcttgagggagcttataacttgcacctagagggtttacccactttgtggatttgatttatccaccaaccacagcaaccaataatgtcaagattctaggagtttatgaaagaggctagtatgttttcattttgagtcagacattcttttctcattctcaaatctgttttaaatgctccaattttaaaaatgccaatgaaaattttataatgcttctgtagtaaccatatgcagtttactttgaatttaggaaaacagttttgtatgatgaaatattgtgcagaatctgtaaataaggtagcttaaaaattaaaaaaaagtctaattagaa

SEQ ID NO: 1225 - DNA, 1157 bp, Homo sapiens
acatgcgcacagagcccgggcggctacggaagcggtgagactgtctctcggctgcagccctggtgcgacccggcccgttgccgtagagatgggcagggctggatggagtggggtgcggtgagctgagctgaccctgcttcgccacggggactgcagtgaccccggcttgccggcagggcgggtaacaggttgagccagggtggggctgctcaggggcgtggagccgaggccaggatttctctgaagacccggcacaggctattcctttctgcgacgagcccattgctatggaaaccaaagcgttaggccagcggggattgaggctgcgggatcatgacgggtctctctcccgaagaaccttgcctaaggcttccccaagcggctacttcctgagcgaacccgcccacccgcctgaaggagagagctttgtttaagactgagaaagtgagggtccgagagtctaatgaatgctctgggcacccaggccgcacctgaggagcaccgacgactgcacggtctgcggcgcgggaagcagatctgcggctgaacctctaccccaattacttagcggcgactgagcctatcgagcagttttccatggacacagcctagcagaaagacgcagccttcgtgcttcgctgactgctgaccactgacccaccgccttgatgacagcaccctcgtgtgccttcccagttcagttccggcagccctcagtcagcggcctctcgcagataaccaaaagcctgtatatcagcaatggtgtggccgccaacaacaagctcatgctgtctagcaaccagatcaccatggtcatcaatgtctcagtggaggtagtgaacaccttgtatgaggatatccagtacatgcaggtacctgtggctgactcccctaactcacgtctctgtgacttctttgaccctattgctgaccatatccacagcgtggagatgaagcagggccgtactttgctgcactgtgctgctggtgtgagccgctcagctgccctgtgcctcgcctacctcatgaagtaccacgccatgtccctgctggacgcccacacgtggaccaagtcatgccggcccatcatccgacccaacagcggcttttgggagcagctcatccactatgagttccaattgtttggcaagaacact

SEQ ID NO: 1226 - DNA, 4039 bp, Homo sapiens
gactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaagttctatattggctgtgatctttgtactaactggtatcatggagaatgtgttggcatcacagaaaaggaggctaagaaaatggatgtgtacatctgtaatgattgtaaacgggcacaagagggcagcagtgaggaattgtactgtatctgcagaacaccttatgatgagtcacaattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcgtttttattggtcataacagtccaattatattcttggccaattttgtccaacggacaagaaaaaagcaaagtcaacgacaccattatcttgtcaagatcagatggttttactattgtggcagaagcgagaaaactttgtttattgaaaaaaaaagaaaaagaaagcaagaaaaaaagatactatggggtcaagtgtaactccatggaaatgccacgtctgctcttcagtgaagaagctggtttagagtctcacagaaaacttttgactgtatttatttattgttgcaaaaaagacgcttttttattgctgccctcatttgtcagctaattattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaaatgagtaaaatctatttgaaggtatcttgtttgtaaacatttgtcagattctaatttttttcttttgtattaaaattcaactatggatgtatatgaaacaaaataaatggagataatttttctcccacagacagaggtgtctttgaatgtgcgctaatgattatctgtaagcctttgtggggagggaggcctgcaaggtcatgaaaggcagaagagtctaattgtgcctggatttctccaggacagcagtggcccctcgttttatcattcccagtccattgtcatcacgtcagagaaaaatcttcaggggtgctaatcctgttgcatcagttgatcatactaacgagaacggtaatgcgacaagatacacattgccttcatctgtacattctgtgataccaggcaaattaccaattacacacagctacttatattttatgaagggcattttttagatgacctcatcctctgtgttatttgttgattgggtttgttttctgtttgttggtttgtttgtttcttccacgtaaggaaaagtagtgtaaacagtagcgagaaaatggaaaccacagaggaagatgtattttgcatgtttttcctttcagtgttcttacacgttgtatcactgcattgtggtaatagcttctataaaatctgccatagttggattatgcagctttgcaaaaatttttactagattttgcactaactcatattagctttgtcctaccaacttctggaatttatctaattattgtttttcaaagtttctttccttttaatgtttccctgctatgcaaaacctttcccagacctcagtttcttaaaagaaagatgttgctacagttcccgattctttcttattacaggctcaggtgtacaggttattctgggttaattttatctaatgaagcccattcctttttgtacataaagatgtcacttaaacttatgcttacaaactaaagactaatcgctcaatatgaaaacatgaaaaaatttttgcttaaagtattaagatggaagtagttaaatatgggttattttgtccttttacttttttaaaaaatgttacatattgtatgcactgtgctgatgcaagaattctacattttaatgagttataaaattattctgcatctcatcacgtcacagtatttctgtactatttattcatatatataaatatatatgggcttaatcatttaaaatttgttgcagcaagaactttcctacctgtaggcaatagattgctatgtttttaacaaattgtggcaaattctaaacagcaattcttttgtacgtaataggacatttcatcctagaaaaataaagtaatgtttttgacattg

SEQ ID NO: 1227 - DNA, 1117 bp, Homo sapiens
tctccaacgaagtcttatattttaccattctgcgtgtattagaaagctaaatttaaacagcaacaataagaaatcttccccagtggatccctcgagcctttcgggaaaatgcaggtttctggctgacaggaagaagaaacagcatccaatcggcacttgtgtctcaatgaccaatcaaatttcgccttacattgcatcgctgggataaacggagctggacgactcagtctcttggtctgtggctgctgcggttacctggatgggcgagcacctctgaggctggctttgttacctgggcaataagggactagcagttcagccgttttctatgcctgctggatttgtttgtatttgttcccagccactgctcatgtaatgtactcccttaaccaggaaattaaagcattctcccggaataatctcaggaagcaatgcaccagggtgacaacgctaactggaaagaaaattatagaaacatggaaagatgccagaattcatgttgtggaagaagtagagccgagcagtgggggtggttgtggttatgtgcaggaccttagctcggacctgcaagttggcgttattaagccatggttgctcctagggtcacaagatgctgctcatgatttggatacactgaaaaagaataaggatggagtggttcttgttcattgtaatgcaggcgtttccagggctgctgcaattgtaataggtttcctgatgaattctgaacaaacctcatttaccagtgctttttctttggtgaaaaatgcaagaccttccatatgtccaaattctggcttcatggagcagcttcgtacatatcaagagggcaaagaaagcaataagtgtgacagaatacaggagaacagttcatgagttgcattgtagcagacaatggacaactgtagtttctgaattgacttctatagccatcttttcccttttttggagagtagactagcaaaactcccttttttctcttgccttttttatgcataaatggaggtcaatttgattgtcctgacctactgtataagtaaatttcaaatgtcattactttctctttgttattataatgtgtgattaaatgcttttttaaattgctaagggaaaataa

SEQ ID NO: 1228 - DNA, 2365 bp, Homo sapiens
agaccagaaacggaagagagcgcgggggatgtgtttggcgtggggcgcactgttcagttgctctcctggatggctttatgtctccgcggtgtttcctagagtctcggcgtttctacctcttcgcaccctttcctgccaccctttgtcccctggaagcccggagacatcagcggctgcaattttgctactcgctgctcggcgtggaactgtcaggacaaaaaataatatccaaagatattttggcactaacggcgctatctgtagcaagaaagttgagcagtgtgaactgttgagacttccaaggagacttcagacaaccaagacagtgtaaaggaaaacagagaaaaagacttgttagacattattaagggcacgaaagttgaattgagcacagtaaatgtacaaacaacaaagccacccaacagaagttcacttaaaagctacaactggcgggcctcaaagagctttaggacatgctccaaagaagagaaatgagcccctgagtcctgagttggtggcagctgcatctgctgctctgttttgacaagcaaacaagccagaactgctcaggcagctccgtagcatgaggaagagtcaggggcacagagagatggagagagacctagttagtttcaataacaaaatatcagatatgaaaattgccagatgtgctacagctagaattaatataaggccagagcatcagattcagtttgaccaaggctatgacaattatcctggcctggagaagactgctgatcttagaaacaggaaaaatatattcagggggaagagatgtaatagatttcacattatggcagttactaaagaagcacgtgaacagacacatcaccttcactttgggatatggaatttgataagcagttagccacagaatatgaacaaccccttgagaatgagattgaagaactgatccaggggacaaaagaggggaaactgagagttcccaattaataatgaagcagcttcatatctaagatctctggtggactttttctgcccgtggacgccgctgaagaagcatcgttaaagtctctcttcaccttgccgtcatgtctaagtcagcgtctccaaaagagcccgaacagctgaggaagctcttcattggagggttgagctttgaaacaactgatgagagcctgaggagccattttgagcaatggggaacgctcacagactgtgtggtaatgagagatccaaacaccaagcgctccaggggctttgggtttgtcacatatgccactgtggaggaggtggatgcagctatgaatacaacgccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtaattgaaatcatgactgaccgaggcagtggcaagaaaaggggctttgcctttgtaacctttgacgaccatgactccgtggataagattgtcattcagaaataccatactgtgaagggccacaactgtgaagttagaaaagccctgccaaagcaagagatggctagtgcttcatccagccaaagaggtcgaaggggttctggaaactttggtggtggtcgtggagatggtttcggtgggaatgacaactttggtcgtggaggaaacttcagtggtcgtggtggctttggtggcagctgtggtggtggtggatatggtggcagtggggatggctataatggatttggtaatgatggaagcaattttggaggtggtggaagctacaatgattttggcaattacaacaatcagtcttcaaattttggacccatgaagggaggaaattttggaggcagaagctctggcccctatggcggtggaggccaatactttgcaaaaccacaaaaccaaggtggctatggcgtttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagtgttttaatgtagatttttttttttgcacccatgctgttgattgctaaatgtaatagtctgattgtgacgctgaataaatgtctct

SEQ ID NO: 1229 - DNA, 752 bp, Homo sapiens
gtaccattcttcaagaaacggtttgaatcagactgcctttccttttgtcttcattgtcataaacatctgcccccgtgtggttctgactggccgcgaacccctacccgaagcttttattccatcattgtgcaccgttggtggggaatgctgtggcaacaggccacgcctccacttactggttggctttgcgcaggcgccaacggaagtgggtcgcaggaagaggaagtcccgcctctctctcctcaggcagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctagtggt

SEQ ID NO: 1230 - DNA, 3118 bp, Homo sapiens
cgcagaagaaccacaaaccccagaagccctcgcgcccactcttctccctcccctccagaagtcggagtgctgtttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagtgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccagcaccatcttctgcagagcccaaattgccctgcttcccctctctcctgcctctaccccttccccaaccaccagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgta

SEQ ID NO: 1231 - DNA, 4401 bp, Homo sapiens
ctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctgccctgcagaggatctatttccgggacatcggtacgatggtgggctggactcaggcttccacagcgttgatagtggcagcaagaggtggtctggaaatgagtcaacagatgaattttcagagctgtcattccggatctcagagctggcccgggagccccggggacccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccaggtgggacagggattttgggaggaggatggggcctgtgttggtgagggctggttgggagagagggacacagaggggatgcctgtctcacctgcccctgtcgctgtgtccctggttccggccccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggtatgggggctgctttctaaagagtggtggcatgccggactcagccgagcatgtggcatggatggtgggcttccatttgcagcggatgtctgctctcagatgaaggcacaggctgcccctgccctgcccagcatgccccctgccctgcatgccccctgccctgcatgtcacctgtcctacacatcccctgccctgcaggccccatcttgtcctgcatgtcacctgtcctgcacatgccctgccctgcactcctcctgcactgcactccccctgcccagcacgtcagcatgtgggcgtggttctggccccagcacgtgagggcaggggtgggagggactgtcctgctgctgctgctgacgtctgtcccttgtccttgtccacctgctctcctctcccccaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtggccgccctgcctgtgtgtgtgtgtgtgcgcgcgcgcgcgcgtctgctccgcgtgttggtggctgtggccatggctctgtgcccaccagcatctccctcctgagatgccggcctctcatgctcccggagcgtccgccaaccccccgtgtcacctcccttctgttatcgctgacagctttcttgcgtctcatttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagcgactgggggcctccatgccttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgc

SEQ ID NO: 1232 - DNA, 2433 bp, Homo sapiens
agtttccaaggtggaagctgggtccggctgccaggaagcggccggtgcgcgggctgcgcgggctgcgcggggctcggcttccacgtgcgagcctgcaccgccgccccgccctctcctggcggccaggcctggggactctctgccgcgggacggcgcctcgcgttccgccgtggcagtggccgtggccagaacgtccacgcgcggtcgtccaccgccggatctcgctccagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattgatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaggcccatgtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagagtgcagtggccgcccacatccatggcctaggagctactgggcaggttcccggccacacatctggtgggctgttttgttttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaa

SEQ ID NO: 1233 - DNA, 3254 bp, Homo sapiens
gcactcggctcggcccggcccgggccgcagcatggccgagccgctactcaggaaaaccttctcccgcctgcggggccgggagaaacttccccggaaaaagtcggacgccaaggagcgcggccacccagcccagcgcccagagcccagccctccagagccagagccccaggctcccgaagggtcccaggccggagcagaggggccctccagccccgaggcatcaaggagccctgcacggggagcctacctgcaaagcctggagcccagtagccgccgatgggtgctgggtggggccaagccagctgaggacacctctttagggcctggggtacctggcactggggagcccgccggcgagatctggtacaaccccatccctgaggaagaccccagacctccagcacctgagcccccggggccacagcctggctcagctgagtcagagggcctggccccccaaggtgcagcccccgccagccccccaaccaaagcctcccgcaccaagtccccgggccccgccaggcgcctctccataaagatgaagaagctgccggaactgcggcgccgcctgagcctgcgaggcccccgggctggcagggagcgcgagagggctgcccctgcgggctccgtcatcagccgctaccacctggacagcagcgtggggggccccgggccggcagcagggcctgggggcacccggagcccgagggccggttacctcagcgacggggactcaccggagcgcccagctgggcccccatcacccacctccttccggccctacgaggtgggtcccgcagcccgggcacccccggccgcactctggggccgcctcagcctgcacctgtacggtctcggggggctgcggccagcgccgggggccacccccagggacctctgctgcctactgcaagtggatggggaggccagggcccgaacagggccactgcgaggggggccggacttcctgcggctggaccacaccttccacctggagctggaggccgccaggctcctgcgcgccctggtgcttgcgtgggaccctggcgtgagaaggcaccggccctgtgcccagggcaccgtgctgctgcccacggtcttccgagggtgccaggcccaacagctggccgtgcgcctggagcctcaggggctgctgtatgccaagctgaccctgtcggagcagcaggaagcccctgccacagctgagccccgcgtctttgggctgcccctgccactgctggtggagcgggagcggccccccggccaggtgcccctcatcatccagaagtgcgttgggcagatcgagcgccgagggctgcgggtagtgggactgtaccgtctttgtggctcagcggcagtgaagaaagagcttcgggatgcctttgagcgggacagtgcagcggtctgcctatctgaggacctgtaccccgatatcaatgtcatcactggcatcctcaaggattatcttcgagagttgcccaccccactcatcacccagcccctgtataaggtggtactggaggccatggcccgggaccccccaaacagagttccccccaccactgagggcacccgagggctcctcagctgcctgccagatgtggaaagggccacgctgacgcttctcctggaccacctgcgcctcgtctcctccttccatgcctacaaccgcatgaccccacagaacttggccgtgtgcttcgggcctgtgctgctgccggcacgccaggcgcccacaaggcctcgtgcccgcagctccggcccaggccttgccagtgcagtggacttcaagcaccacatcgaggtgctgcactacctgctgcagtcttggccagatccccgcctgccccgacaatctccagatgtcgcgccttacttgcgacccaaacgacagccacctctgcacctgccgctggcagaccccgaagtggtgactcggccccgcggtcgaggaggccccgaaagccccccgagcaaccgctacgccggcgactggagcgtttgcgggcgggacttcctgccctgtgggcgggatttcctgtccgggccagactacgaccacgtgacgggcagtgacagcgaggacgaggacgaggaggtcggcgagccgagggtcaccggtgacttcgaagacgacttcgatgcgcccttcaacccgcacctgaatctcaaagacttcgacgccctcatcctggatctggagagagagctctccaagcaaatcaacgtgtgcctctgagccagatgacggggtgggaccccggttagtaaggaccgggcgcccagtggctaaggcggtgccctggtgaccaaggagagccagacctgttgctcaggccgagctcctggttgccagcgagttaccacgggaccagtcgcgtgtatggctgagactcattcccagtttccagggcccggtatttggacactagttgccaagtctggggcctggggattttagggaccagcggttgtgaccatctttcctgagcaccaagggcttccccttttgttgccaaaaaggtagttctcgcgcttgctaggctggcctctcttgcctccccttggccggggcaacaccagttactgtgagcatcaccctggtgtggtgagtcacctctagtcggccctcttgctgctgccaaccaaatcagtattagctttgagcactgcactgtttctccctcccttggacgacacaaagactagcatgaggcactgtttgtggggggcagcccctatcctgggttccagcatggacacaggggtagcctggggcttatagagaaacagctggtttcccctacccttttccggggaagtccccacgattggcctctagtcagcaaatggagataacagagtctggcctttccaatccccatctccttgccccccccttgcccccccccccgaaaaaaattgagcacttaaacccctcccttttggagggggccccctgaagcgtcaggctgggggcagtctggtacggaacatatttattgcctccatgcatgtgtgtgtgtgtctgtgaggactggtgtgcgtggacacgtctgaagcaggcgtgtggggctctttcagggaccacagaggagggagcagtttgcagtgcccagccaccctgaaatccccaataatggtgcctcagtgggccccagagttccagtgggagagtacggttccctcctgtctccctcttcttttccgcacctccatctttgtggataataaataaatatgcacaggttctg

SEQ ID NO: 1234 - DNA, 1461 bp, Homo sapiens
gcgtggcaggagaggcggggccaattttgctgagctttctcgcgggcttgcagctgcggcaagtgctggcggcggctgctcgcgcaagtcagctggcgtgggaactaccctttgtagctgagaacggcttgtttattgctacaaagactctattgacattggtagcttcagcggcagcagcttcttacggtataaagctgttgcttcctgaagaggctacaagcatccttccctaggactgctgtaagctttgagcctctagcaggagacatgcctcggggacgaaagagtcggcgccgccgtaatgcgagagccgcagaagagaaccgcaacaatcgcaaaatccaggcctcagaggcctccgagacccctatggccgcctctgtggtagcgagcacccccgaagacgacctgagcggccccgaggaagacccgagcactccagaggaggcctctaccacccctgaagaagcctcgagcactgcccaagcacaaaagccttcagtgccccggagcaattttcagggcaccaagaaaagtctcctgatgtctatattagcgctcatcttcatcatgggcaacagcgccaaggaagctctggtctggaaagtgctggggaagttaggaatgcagcctggacgtcagcacagcatctttggagatccgaagaagatcgtcacagaagagtttgtgcgcagagggtacctgatttataaaccggtgccccgtagcagtccggtggagtatgagttcttctgggggccccgagcacacgtggaatcgagcaaactgaaagtcatgcattttgtggcaagggttcgtaaccgatgctctaaagactggccttgtaattatgactgggattcggacgatgatgcagaggttgaggctatcctcaattcaggtgctaggggttattccgccccttaagtagatctgaggcagacccttgggggtgtaaaagagagtcacaggtaccccaaggagtagatgccagggtcctaagttgaaaatgatgtcgattgggggcgggggacactgtatttgatatttgtgatcagtgatcattgttcaactgcgaaatagagtgtttgcttttgataatggaaaattgtattcgttttaaaattccgtttgttgagaataacaatatgtttaaaaatataattgaacaaatttttttctttgtttcctgtcattgacatttagtataacagttttgctaacgttctaaaatgaagtcgttccatcataatctatgatcttgtacagcacttatagaaataagctgttcttttgaagttgaaatacccagtaaaatgttgaagaaggatggaggatttcttcatatctgacgtttctgaaaccctttgtgtctgctgttgtgtgaagattgacatttaccatgattttccttagttactgcagaacatagagaaaaataaaagcctaacgaatagt

SEQ ID NO: 1235 - DNA, 830 bp, Homo sapiens
tcctccacttcgtcccggcccttgtcctgtggcaggtgctccgctcaagatgaatctcaacttcacctctcctctacacccggcgtcttctcagaggcccacatccttcttcatcgaggacatcctgctgcacaagcccaagccgctgagagaggtggccccagaccatttcgccagctctctggcctctcgggtgcctctgctagactatggctaccccctcatgcccacacccaccctcttggctcctcacgcccatcaccctctgcataagggagaccaccatcatccttatttcctcaccacctcggggatgccagtcccagcgctgttcccgcacccgcagcacgcggagctgccggggaagcactgccgccgccgcaaagcccgcacggttttctctgactcgcagctctcgggcttggagaagaggttcgagatccagcgctacctgtccacgccagaacgagtggagctggccacggccctcagcctgtccgagacgcaggtgaaaacgtggttccagaaccggcggatgaagcataaaaagcaactgcggaaaagccaagacgaacccaaagcaccagacgggccagaaagccccgagggcagcccccgcggttcagaggccgccaccgccgccgaggctcggctgagcctgcccgccggtcccttcgtgctgaccgagccagaggacgaggtggacattggagacgagggggagctgggctcagggccgcacgtgctctgagccgccaggctggggagggtagtaggcaggggaggagactgcggggccgagcgcggttccctcctggaccggaagactc

SEQ ID NO: 1236 - DNA, 873 bp, Homo sapiens
atggagctgccagctgttggcgagcacgtcttcgcggtggagagcatcgagaagaagcggatccgcaagggcagagtggagtatctggtgaaatggagaggctggtcgcccaaatataacacgtgggaaccggaggagaacatcctggaccccaggctgctgatcgccttccagaacagggaacggcaggagcagctgatgggatatcggaagagagggccgaagcccaaaccgctagtggtgcaggtgcctacctttgcccgtcgttccaatgtcctgaccggcctccaggactcctccactgacaaccgtgccaagctggatttgggcgcgcaggggaagggccaggggcatcagtacgagctcaacagcaagaagcaccaccaccacgccgtcggcctgaatctctcccacgtgcgcaagcgctgcctctccgagacccacggcgagcgcgagccctgcaagaagcggctgactgcgcgcagcatcagcacccccacctgcctggggggcagcccagccgctgagcgcccggccgacctgccaccagccgccgccctcccgcagcccgaggtcatcctgctagactcagacctggatgaacccatagacttgcgctgcgtcaagacgcgcagcgaggccggggagccgcccagctccctccaggtgaagcccgagacaccggcgtcggcggcggtggcggtggcggcggcagcggcacccaccacgacggcggagaagcctccagccgaggcccaggacgaacctgcagagtcgctgagcgagttcaagcccttctttgggaatataattatcaccgacgtcaccgcgaactgcctcaccgttactttcaaggagtacgtgacggtgtag

SEQ ID NO: 1237 - DNA, 826 bp, Homo sapiens
ggcgctgagttttgtctcccgggccgtctgggcgcgcgcgggtgtcccagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgt

SEQ ID NO: 1238 - DNA, 877 bp, Homo sapiens
tagaaatccacccagaacctccaccctctgacaccatggtcagctcctgttgtggctctgtcagctctgagcagagctgtggcctggagaactgctgccgccccagctgctgccagaccacctgctgcaggaccacctgctgccgccccagctgctgcaagccccagtgctgccagtctgtgtgctaccagcccacctgctgccaccctagctgctgcatctccagctgctgccgcccctattgctgtgaatccagctgctgccgcccctgctgctgccagaccacctgctgcaggaccacctgctgcaggaccacctgctgctgccccagctgctgtgtgtccagctgctgcagaccccagtgctgccagtctgtgtgctgccagcccacttgctgccgtcccagctgctgcatctccagctgctgccacccctcttgctgtgaatccagctgctgccgcccctgctgctgcgtgcgtccagtctgtggccgagtctcctgccacaccacttgctatcgcccaacctgtgtcatctccacctgcccccgccccttgtgctgtgcctcctcttgctgctaatgtctccttgtgatatttgtcatactatgaatgtcttcattagtcatttaaaatgcactgtagccagccagtcactggaaaaatgaacacttccctgccagtttgtctcatgtggcattcagagtggacattcagctcttctaggaaatgacagacaatcacattcattaaaatatgttatgccaggccccaatgcagttatttttagatgagcagtgtcttcattcgaaggggacactaactgtgatgatctcatataatattgttttcatgtattaataaacagccacttccct

SEQ ID NO: 1239 - DNA, 4572 bp, Homo sapiens
agcaacagagtttagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatatttttgtagattaattgttgtaacattgtctttcttttttttcttttgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagg

SEQ ID NO: 1240 - DNA, 1563 bp, Homo sapiens
cagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgtttagcatacgaggaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatc

SEQ ID NO: 1241 - DNA, 1217 bp, Homo sapiens
cagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatatagagacggggtttcatcgtgttggccaggctggtctccaactcttgacctcaagtgatccacctgccttggactcccaaagtgctgggattacaggtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcatcgtattgtgtatattca

SEQ ID NO: 1242 - DNA, 1928 bp, Homo sapiens
cctggttcgttaaccggaagtagacgtacctcacggaagccggctttggccctgcggctgctaccgtcgccgcggagaaattgttggatctggcagtctaggaatgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataa

SEQ ID NO: 1243 - DNA, 1689 bp, Homo sapiens
ggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatgcattcatggctctggacgcattggctgatggtggggtgaagatgggtttgccacggcgcctggcaatccaactcggggcccaggctttgctgggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatctgtcccctctgtgattcagagcccttagttgagagcccctgccgcccctgccacccccctgccccgctcccaccattgcccctcctcagctgtgcaaggagaaagcatgcttaggaagttttcaggtccttgtgataaaacctccttaaatctgttcagaccaagcaatgcgagcttcctctcctgtcccatgttggaagttgctctgaaggggtggtagatgctggaagccagacacaaccctgcgtacgctgctcagttggtggagactggggctgggactggagtcagcccagctgggaggaggggctggggaggatctgcagctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaatatc

SEQ ID NO: 1244 - DNA, 8189 bp, Homo sapiens
gcggcggcggccaaactccgcggcgtccccagggcgccagcttcgccctcgccgccgcggccgcgctgctcttcggctccgacatggaagatggaccttctaataatgcgagctgcttccgaaggctgaccgagtgcttcctgagccccagtttgacagatgaaaaagtgaaggcatatctttctcttcacccccaggtattagatgaatttgtatctgaaagtgttagtgcagagacagtagagaaatggctgaagaggaagaacaacaaatcagaagatgaatcagctcctaaggaagtcagcaggtaccaagatacgaatatgcagggagttgtatatgaactaaacagctatatagaacaacggttggacacaggaggagacaaccagctactcctctatgaactgagcagcatcattaaaatagccacaaaagccgatggatttgcactgtatttccttggagagtgcaataatagcctgtgtatattcacgccacctgggataaaggaaggaaaaccccgcctcatccctgctgggcccatcactcagggcaccaccgtctctgcttatgtggccaagtccaggaaaacactgctagtagaagacatccttggagatgaacgatttccaagaggtactggactggaatcagggactcgtatccagtctgttctttgcttaccaattgtcactgcaattggtgacttgattggtattctcgagctgtatcggcactggggcaaagaagccttctgtcttagtcaccaggaggttgcaacagcaaatcttgcctgggcttcagtagcaatacatcaggtgcaggtatgcagaggccttgccaaacagacagaattgaatgacttcctactcgacgtatcaaaaacatattttgataacatagttgcaatagattctctacttgaacacataatgatatatgcaaaaaacctggtgaatgccgatcgttgtgcgcttttccaggtggaccataagaacaaggagttatattcagacctttttgatattggagaggaaaaggaaggaaaacctgtcttcaagaagaccaaagagataagattttcaattgagaaaggaattgctggccaagtagcaagaacaggggaagtcctgaacattccagatgcctatgcagacccacgctttaacagagaagtagacttgtacacaggctacaccacgcggaacatcctgtgcatgcccatcgtcagccgaggcagcgtgataggtgtggtgcagatggtcaacaaaatcagtggcagtgccttctctaaaacagatgaaaacaacttcaaaatgtttgccgtcttttgtgctttagccttacactgtgctaatatgtatcatagaattcgccactcagagtgcatttaccgggtaacgatggaaaagctgtcctaccatagcatttgtacttcagaagagtggcaaggtctcatgcaattcacccttcccgtgcgtctctgcaaagaaattgaattattccactttgacattggtccttttgaaaacatgtggcctggaatttttgtctacatggttcatcggtcctgtgggacatcctgctttgagcttgaaaagttgtgtcgttttattatgtctgtgaagaagaactatcggcgggttccttatcacaactggaagcatgcggtcactgtagcacactgcatgtatgccatacttcagaacaatcacacgcttttcacagaccttgagcgcaaaggactgctgattgcgtgtctgtgtcatgacctggaccacaggggcttcagtaacagctacctgcagaagttcgaccaccctctggccgctctctactccacttccaccatggagcagcaccacttctcccagactgtgtccatcctccagttggaagggcacaatatcttctccactctgagctccagtgaatatgagcaggtgcttgagatcatccgcaaagccatcattgccacagaccttgctttatactttggaaacaggaagcagttggaagagatgtaccagaccggatcactaaaccttaataatcaatcacatagagaccgtgtaattggtttgatgatgactgcctgtgacctttgttctgtgacaaaactgtggcccgttacaaaattgacggcaaatgatatatatgcagaattctgggctgagggtgatgaaatgaagaaattgggaatacagcctattcctatgatggacagagacaagaaggatgaagtcccccaaggccagcttgggttctacaatgccgtggccattccctgctatacaacccttacccagatcctccctcccacggagcctcttctgaaagcatgcagggataatctcagtcagtgggagaaggtgattcgaggggaggagactgcaacctggatttcatccccatccgtggctcagaaggcagctgcatctgaagattgagcactggtcaccctgacacgctgtcccacctacagatcctcatcttgcttctttgacattcttttcctttttttggggggggtggggggaacctgcacctggtaactggggtgcaaacctcttcaagaaggtaacatcaaataaataagtcaagcagaggacttcctgccaatctcttctgtgaggcatcatagacactgagcaaccaggaccacccccacgttcagaaatcagctggccaagtgactccatttgacttgcaaaccagccttttctaataggctaatattgctgaggccttaaaggaaatggacaaaaattatccagaaggggtacttttccattgtatctttctaataagggtttaaaatggtactattatggtattgtacttgggctttaacatcaatgttgctttgatgttgttggatataaataggaatttttacacattactattgtgaatggtgaatgttcatgtatgacctacttgtaattaacttgagttgtagtccacagcctcaggacaaatgtcgttgaggttacagagtaagaaatgatggcaaaacgtcaaactcttatttcagagcttcatgaatttagttagactaaacataattctttaagttcaacctaaagggctgagatcaataaatttaacactagacgaagtagacttcctgtctttttgagaagagatgaggtatatgttacaataaatctcagaacttcaagtagcagttcaaaagatgtcagtttttaaaattgtttttgttgttgtcttggcagttttactgaaccctttgcataaagaacaaaataaaagctcggcattgtaatttttttaatggacaagtcttatggatacgaagggtacatttttcataatgattcctttatattttcactttgtgtcattgcagaattttagactctcattcacaatgaaaagtttattttaaacattgtttaattaaaataccatacagttctcttttaaacatcaaaccataaaaagtgtattttgtaattttactctgacctgccgcagtcacctctcacttatctcttccacgtactgcacggtcgtatttcatgagctttctgtccatagcacagaaacagagcagaaagtagtacaatcatgttggaccttctttctgttctctttactcttctcacagatcagatcactccatagaagcctgtgggtttcgatggtttcttctatacacctttttggttgaccagtattactatacaatgtaagtgttttaaaaaatacgaaagtaatactctgcaccccttcctacaaagatgataaagcagtcacttctggcgcattttaataatttaaagatttttagtgcaatggcacggtaacctccaaacctgaattagacagagactcactcaggaagtgacaggcccatcatatcaaataacttattcacttttcatgtggcaggaaactggaatatcgcttttaataaaatggaaaaatatgcttctacatatttaccaccataggcgttttgttcatatgagcctggtttgtgcaaaattaaatcagaggcttctacaacatggtttatttatgttgtagcaaagttggctctacataaacattgttcttattttaaaattaacactatgtgttcagttttcttgtgggcttctgaaagttgccatcttccctccgtggagctccatttgctattttcattatacactatgaggtaaaatgtaataacaaaagagagagaagtaccactgtggctagatatatacacacacatatatatatggatggatgtaatatatgtagaacacacacatagatgtatataggatacacactcatgtatgtaaacgtatacatatgtgtatatatgatacatacacatacacacacacgagagacagaaggaaagagaggaagagagaagcaaacatgtaggaaaaaatataaatcagccccattctcccattctttaagaacaatgatttttcttgatggaaaatgcatatcacttgacagttgacaagaaagtgtcatttttgtgttagtgtatcatataattgaatttgaacaagatacatatttttctgcatacaaatttatgaagctggagtctaccaaacacagctttagtcacaaaagttagtttagttatctcatttcgcttggagatggaatttcaggaagggatatattatttaagattattgtttaattacaagaattttaaaagaatgtatgaattctgttttttaatatagaaaataattatggagttaggaatctcatggctacatttacatttttaggttattacagaaaattctcttaatttattatagtcaagtgtattatgtaatctctatttagaacagtttcccaaaggaatgtgattggatttactggttggttaatttcttgtgaaatattgtcataatagaagcacagcttgaacaaaagactgaattctgatataaactgtcaatattgcttttaccatgtgtaagatttacttagtaatcacagatttacctaaaataaaaggacccgggttgcagtgatatttagttaatgatttgttttggaaaacatgcagttaggagtatttttgtattttgtcagatgtttaggagacagactttcgggtcatgtttcttgtcttgttcccagatcttttcttaaaagaacagtgtgacaccagaagccaagagatggtttttactaacaacagctttgatgagttcctattaaggtcgtattgtgtattgtgccaaattttccacccagtataaatttagtaacccgctatgagcatatgtaggatattcaatttgcagatacttttgttggttatgttggtttataatagacaagttttatggtcatatgcaattattccattatctttttggacacagtgaatatgttttttagctaaaaatgtccttggaaacataaatgcctgccaataacatggaatattgaattcgggcaatgtgaattgattaattagaaaagggtcaaaagaaatacaatggatgtggaaactaattctaaaaaatagccctattaatagggcagagactctggtccatttcccagctgtacttctctctaagaggtgtatgaaaaacccatcttgcaaaagagaccaaaatattagacacaatcgttcccattcctgactcttcaatggaaaaggaaggtacagatgtttacagtggtgccccaggtgactcgttctcaccacaacaaaagcaactaattggaaactagatgtgttcaataatagatttcctcttttttggcatgctttttagattttttttcattttgtaaaatctcagttaatttttctttattggtatatttgtgtatgcgagacaaatcctgtattgtacaggatataaatagatgcataaatccttagatacctgggttttttaataggtttaggtttgggtattgtgtttctggtcttttaactcaaaattaaggtttgagctttaataggactaaattattcacctgccttggcctgtgcctttattttaaatactgcaattttacttcttcattcatgtatttattattttgcttttcttgcttaagtataattgaaaatatttgcaggaacgcacaattcattttatcaagttgaatgaataggaccattctctcctcatcagatttctgttctttatttgacttcattgacatataccctggtgactataaccagtgaactgttcagagtcagtcttttcggcaagaacttcagagaactgtgacactggttatgatgtgattttggggggtttcaggtacctaagcatgatttttaaaatcacttctctctttacatatttcgaacatatgtttgctttctacactttgcagattttatttaggatttaattctttaaagactatattcatttagtcactatagtggatctcttctactgcaagtattcatctgatttttaaattatgtaaaatgtaaatcagccaagtatgtcatccgttatagtttccccatgctttcagcgcatggccatgagatttttacatgtgcataagtatttagccaatacacattttgctgacttctttaaccatttatattgtttaaattagtaatatccaatgcagtgcacacttttttgtcttttttccaacggaatattttggttgtctgtagcgttggaagcattttatatgataaaaatagcaagaaaaaattaaaaagtgtcaacggtgtgctggttctaaattaagaagatagaacaaagagaaagacattaatgttacctaagaaacacatttaacatccgaagaagcaatgctgtcctcacttgatgtttctcttctcaacccagcaatggagagcagggcttgcaaagccgtacagagcctacgtgctctttcctgcaagtgggagaaaactaatcaatggcacacagggccaggtgtggccctgtgaggcaaaggataatgtcacctcaggaccaaggtggaaacttacagctgaatccagggcttactaagtagggaagtcagtttacatatttcagttttcctctgatgtttttgaggtactgtgtatttgcagaagtttaagcagaagggttttgtttctattgtaagttaggttctaaaagtgtataatctgatactctagcccaactgaaatattatatcttgggcgttacagcctttgtctttttctttagtcaccttaatacccagtcctatgctgtatctctgatagcctatataaatgacatataggaatattattttccatatgatctgttgtatggtgtatatgctatgtgttcatttcgtgtgcaagttcagagtgtaatagatttacccagagaaggtgtttctatacaatgcccctacctatttgaaattacatgcttgcccaacacactgtgaaatagttaccaaaatttgtacaaatgcagcatcttcattctttctgagaagacaagatggttttctttacatgaacaaatgaacaaaagagatcctagatccataacgtagctaaggcatctaagagtttgctgttgataatcttgctgaccaaaaactactggagagtaacacaggttatatgccatcacaaatacaatgctcatgaagaactgatttgtagagtcaatgaacctgtgtccagaattttaataggctctctattggaaggagaaagaatttcaagttaacagtatctaactttatcatagttgatgttagtaaattttaaaaaatgattttatatgtatgacaaaaatctttgtaaaatgcgcaagtgcaataatttaaagaggtcttaactttgcatttataaattataaatattgtacatgtgtgtaattttttcatgtattcatttgcagtctttgtatttaaaaaacatttactgttatgtttgtataatagaacagtaatcatttattataatctaggcaagttgtaaataaattcataattcaaacagccagtatatatgcatatatgagtgttatattgcaaaatctttgttttacttacatggttaaagcagcaagaattcttttgttgatatgtaattatacacataaaatatatatatgtatgatacatgaaatatatttagaaatgttcataattttaatggatatcctttggtgtgaataattgaatacagagtttttaaaata

SEQ ID NO: 1245 - DNA, 2190 bp, Homo sapiens
gagggcggggcgagggcggggcggtgggcggggacggggcccgcacggcggctacggcctaggtgagcggctcggactcggcggccgcacctgcccaacccaacccgcacggtccggaagtcgccgaggggccgggagcgggaggggacgtcgtcctagagggccggagcgggcgggcggccgaggacccggctcccgcgcaggacggagccgtggctcaggtcggcccctccccaacaccaccccgggcctccgccccttcctgggcctctcggtggagcagggacccgaaccggtgcccatccagtccggtgccatctgaagcccccttcccagaaaatgagccacagagcaagctgaccccagcgacacagccccccagccctactgtatttccgttcctatcaaaaaatggatgactcggagacaggtttcaatctgaaagtcgtcctggtcagtttcaagcagtgtctcgatgagaaggaagaggtcttgctggacccctacattgccagctggaagggcctggtcaggtttctgaacagcctgggcaccatcttctcattcatctccaaggacgtggtctccaagctgcggatcatggagcgcctcaggggcggcccgcagagcgagcactaccgcagcctgcaggccatggtggcccacgagctgagcaaccggctggtggacctggagcgccgctcccaccacccggagtctggctgccggacggtgctgcgcctgcaccgcgccctgcactggctgcagctgttcctggagggcctgcgtaccagccccgaggacgcacgcacctccgcgctctgcgccgactcctacaacgcctcgctggccgcctaccacccctgggtcgtgcgccgcgccgtcaccgtggccttctgcacgctgcccacacgcgaggtcttcctggaggccatgaacgtggggcccccggagcaggccgtgcagatgctaggcgaggccctccccttcatccagcgtgtctacaacgtctcccagaagctctacgccgagcactccctgctggacctgccctaggggcgggaagccagggccgcaccggctttcctgctgcagatctgggctgcggtggccagggccgtgagtcccgtggcagagccttctgggcgctgcgggaacaggagatcctctgtcgcccctgtgagctgagctggttaggaaccacagactgtgacagagaaggtggcgaccagcccagaagaggcccaccctctcggtccggaacaagacgcctcggccacggctccccctcggcctattacacgcgtgcgcagccaggcctcgccagggtgcggtgcagagcagagcaggcaggggtgggggccgggcctgcaagagcccgaaaggtcgccaccccctagcctgtggggtgcatctgcgaaccagggtgaagtcacaggtcccggggtgtggaggctccatcctttctcctttctgccagccgatgtgtcctcatctcaggcccgtgcctgggaccccgtgtctgcccaggtgggcagccttgagcccaggggactcagtgccctccatgccctggctggcagaaaccctcaacagcagtctgggcactgtggggctctccccgcctctcctgccttgtttgcccctcagcgtgccaggcagactgggggcaggacagccggaagctgagaccaaggctcctcacagaagggcccaggaagtccccgcccttgggacagcctcctccgtagcccctgcacggcaccagttccccgagggacgcagcaggccgcctcccgcagcggccgtgggtctgcacagcccagcccagcccaaggcccccaggagctgggactctgctacacccagtgaaatgctgtgtcccttctcccccgtgccccttgatgccccctccccacagtgctcaggagacccgtggggcacggaacaggagggtctggaccctgtggcccagccaaaggctaccagacagccacaaccagcccagccaccatccagtgcctggggcctggccactggctcttcacagtggaccccagcacctcggggtggcagagggacggcccccacggcccagcagacatgcgagcttccagagtgcaatctatgtgatgtcttccaacgttaataaatcacacagcctcccaggagggagacgctggggtgcac

SEQ ID NO: 1246 - DNA, 9288 bp, Homo sapiens
agtgctcgcccgcccgaccccggcggctcgcgcccgggagcgccgcagggtcgctagagtcggccgcgtcctttgtgtggcgctcaggctgcgccgcggggcggcgggacggaatgtgggcgctgcgggggcttttctctcctacccgaactgtgggaacaatggactgaaaggggaagatggattgaggggccgagcggggaagcgagctgcaccggggaatcatgacttctgcagccgagataaagaagccaccagtggcccccaagcccaagtttgttgtggcaaataataagccagccccacctcctattgcacctaaacccgacattgtgatttctagtgttccacagtcgacaaagaaaatgaaaccagcaatagccccaaaaccaaaagtcctgaagacctcacctgttcgagagattgggcagtcgccatcaaggaaaatcatgttgaacctggaagggcataaacaggaattagctgaaagcactgacaactttaattgtaaatatgaaggcaatcagagcaatgattatatttcaccaatgtgttcctgcagttctgagtgtatccataagctgggccatagagagaatttgtgtgtaaagcagcttgttttagagcccctggaaatgaatgaaaatttagaaaacagtaaaattgatgagactttgactataaaaactaggagtaaatgtgatttgtatggtgaaaaagccaagaaccagggtggggttgttttaaaggcaagcgttttagaagaggagctcaaagatgccttaatacaccaaatgccaccttttatttctgcacagaagcacaggcccacagacagcccagaaatgaatggtggctgtaattcaaatggacaattcagaattgaatttgcggatttgtcaccttccccatccagctttgaaaaagttcctgatcatcacagttgccacttacagcttcctagtgatgaatgtgaacattttgaaacttgccaggatgacagtgaaaaaagcaataattgctttcagtcatctgaactagaggctctggaaaatgggaaaaggagtactttaatatcttcagatggagttagtaagaaatcagaagtcaaagaccttggtcccttagaaattcatttagtaccatataccccaaaatttccaactcccaagcccagaaagacacgaactgctcgtctgttacgccaaaagtgtgtagatactcctagtgaaagcactgaagaaccggggaattcagacagtagctcttcctgtcttactgaaaatagtttgaaaatcaataaaatcagtgttctgcatcagaatgttttgtgtaagcaggaacaggtggataaaatgaagctaggaaataaaagtgaattgaatatggaatccaacagtgatgcacaggacttagtcaattcacagaaagccatgtgtaatgaaacaacttcctttgaaaaaatggcaccttcttttgataaagactctaatttgagttctgacagcacaactgtagatggttctagtatgtcgcttgctgtggacgaagggaccggttttataagatgtactgtatctatgagcctgcctaagcagctcaaattaacttgcaatgaacatttgcaatctgggagaaacctgggagtttctgcccctcaaatgcaaaaggaatctgttataaaagaggaaaattctctacgaattgtccccaaaaaacctcaaagacatagcttgcctgctacaggagtgcttaaaaaggctgcctccgaggagcttttggaaaaaagttcttatccttcaagtgaagaaaaaagttcagagaagagtctagaaagaaatcaccttcagcatttgtgtgcccaaaaccgtggtgtgtcatcctcctttgatatgcctaaacgggcttcagaaaagccagtgtggaagttacctcatcctattttacccttttcagggaacccagaattcttaaagtctgtcaccgtatcgtcaaacagtgagccttcaacagccctaaccaagcccagagcaaaatcgttatctgctatggatgtggaaaagtgcactaagccttgcaaagactctacaaagaaaaactcttttaaaaagttgctcagcatgaaactgtccatctgtttcatgaagagtgactttcaaaaattttggtccaagagtagccaactcggagacaccaccacaggccacctctccagtggggagcagaaggggattgaaagtgattggcaaggcttgttggtaggagaggagaagagaagtaaacccatcaaggcatattccacagaaaactatagcctggaatctcaaaagaagaggaagaagtctcggggccagaccagtgcagctaatggtctgagagctgagtctttggatgaccaaatgctctcccgggagtcatcatctcaggcaccttacaagtctgttacaagcctctgtgcaccggagtatgaaaatatacgccattatgaggaaataccagagtacgagaacttgccatttattatggctatacggaaaactcaagagttggaatggcagaattccagcagcatggaggacgctgatgcaaatgtgtatgaggtagaagagccgtatgaagctccagatggccagctgcagcttggacccagacatcagcattccagttcaggagcatcccaggaggaacagaatgatcttggtcttggtgaccttccctctgatgaggaggaaatcatcaacagttctgatgaagatgatgtcagctctgagtcaagtaaaggagagcctgacccactggaagataaacaggatgaagataatggaatgaaaagtaaagttcatcatattgccaaggagatcatgagctcagagaaagtgtttgtggatgtgttaaaacttttgcatattgatttccgggatgcagtagctcatgcttccaggcaacttgggaaaccagtgattgaggaccggattctaaatcagatcctatactacttgcctcagctgtatgagctcaaccgggatctcttgaaggaactggaggaaagaatgttgcactggactgaacaacaaagaattgctgatatctttgtaaagaagggaccatatctaaaaatgtattccacatacatcaaagaatttgataagaatatagccttgctggatgaacagtgcaagaaaaatccaggttttgctgctgttgttagagaatttgagatgagccctcgctgtgctaatctggccctcaagcactacctgctcaagccggttcagaggatcccccagtacaggctgttgctgacagattatttgaagaatctcatagaagatgctggagattacagagacactcaagatgcccttgctgttgttatagaggtagccaaccacgccaatgacaccatgaagcaaggagacaactttcagaaacttatgcaaattcagtacagcttaaatggacaccatgaaattgtgcagcctggtcgggtttttctcaaagaaggaattctgatgaagctgtctcggaaagtgatgcaacctcgaatgtttttcctgtttaatgatgccctgctgtatacaacaccagtgcagtctgggatgtataaactgaacaacatgctctcactggctggaatgaaggtcagaaaacctacccaagaagcctatcagaatgaattaaagattgaaagtgtagaacgttccttcattctctcagccagttctgccacagaaagggatgaatggctagaagcgatttccagggcaatagaagagtatgccaagaaaagaatcaccttctgtcctagtaggagtcttgatgaggcagactcagaaaataaagaagaagttagtcctcttggatcgaaggctcccatctggattcctgataccagagccacaatgtgtatgatctgcacaagcgaattcactctcacctggagacgacaccactgccgggcctgtggaaagattgtatgccaagcttgttcgtctaataagtatggcttagattacctgaaaaatcaaccagcaagagtatgtgaacattgtttccaagaactgcagaaattagatcaccagcactcccctaggattggatctcctggaaatcacaaatctccttcaagtgccttatcatcagtcttacatagcattccatcagggaggaaacagaaaaaaatcccagctgctctcaaagaagtatcagcaaacacagaggattcttctatgagtggctacttgtacagatcaaagggcaataaaaaaccctggaaacacttttggtttgtcataaaaaataaagtactatatacatatgctgcaagtgaggacgtggccgctttggagagtcagcctttattaggattcactgttattcaagttaaagatgagaattccgagtctaaagtatttcagttactgcacaaaaacatgttattttatgtattcaaagcagaggatgctcattcggctcagaagtggatagaagcatttcaggaaggcacaatattgtagcagtattggtttcatctcttctgtgattccaaagaggtggaatttcatcagaatggagtaaatgcaattcaaaaattgtataaaaatgaacactgccaagataaagccaaccagacccttcatcaaagaaattgttttgttaggtataagcaatttttaaaaggtgtttgttttttcatttatgttatttattaaaattttgatgtttacttaatggtcagaattatttctgagacacactgaattctaaagtaccatttctttagagaccagaaaaactatcttaatactgtatactgtattaactattcgtgacatagttcacactgttttcttaccttacattgtaacaatcttactggtggaaagtctttgtaaggaaaaaacacatagcaaggagcaaatttccacaaagtgcttggtttaggaattgtgattattataaaactgctgatgaaaaaaatgcatgtctttgaatcaataaacttgggtgaatatttgtatcttttagtggaaaaacatggccagcttctacctcagtaactgtgaactgaaatttcagtaaattatctaaagtatttctgttgttaggtacctctttggcaggagttaatattacatcatcaaagaattatagcaaagagatagaatctgaattttttaaaactgtgagtaggaatgaagatgtttttatttgcagaataccacaaataaccaactcttccggcttttaagtccaatcttttaaaaaatctaccacttcgaaacaaacataaatgtatcattttttaaaatagcaaaatatagcaagcattatgtcacataatattccctgctattataagagttctgagcccaagtcaatgatgatatttgtatctataagtaatgttacatttccaaaaatattgtgcattacaaatggaactggaattactatatcagaaaagcataattataagccagtaataactgaaattctatagtattcattttcaaaaggtctttttctgccagtttgtgatatcctccctcctaattaaaaaaaaaaacaacaaatcctttctctataagcagctatcagcacacctccttaggaaagatttagattcataattctggtgcacttactgtttaacatatgaactaccttgcacatacaattgttgattagcagaagaaaatgaaataacactgtgataaaagccatccctgatgttcacaatacacaatttattaactaagtttaaactataaattatcttaactgccatgagcggtggctcacacctacaatctcagcattttgggaggccgaggccgttggaccacctgaggtcaggagatcgagaccagcctggccaatatggtgaaaccccatctctattaaaaatacaagaattagccggtcgtggtggtacatggctgtagtcctagctattcagcaggctgaggcaggagcatcgcttgaacccaggaggcagaggttgcagtgagccgagatggtgccactgcactccagcctgggatgacagagcgagactccatctcaaaaaaaaaaaaaaaaaaaaaattgaacagcaaggttatccatataatatttctttaaagggtacaagaattttcctttctgcctctaaataaaggatttcctaattcagtgtgatccttaacagcaaccatgaggattactgagtgcctttctggggccttttgaatgctgtttggtacagcaccagagtccctactagatctagagttggctgctatagttttttgtggcgattttttgccatggagtcatttgaacctcatacacaatcctaacatgccatcccctttctgtcatagcaggtacactaaaatttctttgtagctcaattttatataatcaagatcacataaataaggcttccatgttagaatcgttgcagtttttagtgtattcctttttggaggctaaagttgtaccttataaactgtttctgcgtctggcatttagcaagacaagttatttgggttttctttccctcctcttgagctctcagccttctgactacaaggtttggcttaagccttataatctaaaaaatatcagccaggctattctatcttctaagacctggctgaatcatgagccagttctaaatctaaagagagtgagagagggaagaaatctggcacaaacttacagtctctttaattacatgtaaaatgcatgtgactgtattacctattggcttagccccatggagggtttagaaaaatgtgtagtctttgtggaagctatccaattatccttctcccaaaaagatgttttaaatgtggaatagtattacattcccctgcccctttatgagtccttcataacttactaaagctgaccaattgttatttatgtaacctggctcattcattgtcaactaagaacctaattatatgcaatttattgtaaaaaaagctataaaaatatattttgctagtattttagaggaaaaatgatattgggcacagtctataaatggggagaaaagttaagtagtatctagattccaaggatactatatttattatacagatatgtgtgcctgtgcttccatcaaaccctttttcaggtatctccttttaattcataaggaggaaagagtagggcatttataaagctaagctaaaaatgatgctaagcataacgtagatgagacgccaggctgaaccaggggaaggctggcattgttagtgtccccaactagcagtccacctttatctgtggcagctataaatgtacaggacccatcagagtcctaagaaaatgagagtaattatctctggcatcatccacatttccgactctttccaatctcttttccctttttctgtaatgtacccagcatccccctattgtattttggttgcccaagattcttgattctttgagtgtgtagtagcatttcttaaaatgagatcatcagaccaacccttgattcacatgaaagctgtaatgacacaacaaagagaaggcgacagttttaaagtataattgtcagccaaatgtgtattttatatttggttcatagaatatatctagatgtggggaaagtctcctatttggtaatttagttaaaatgtaaatgttatatcacagcatatgttggtatgttttggagtgtgcttccattgtgctcagcttttgaaaagtttgaaatccactttagtcaaatgtagtcaatgggatttccagagatacatattgtttttcttagtgtaccacacactccttgaaggcagatactgtacttaatatatcactgtcttccataatactgccctaggtctttttagtttttaagagaccgggtctcgctatgtttcccatgctgaactcaaatgcctgggcttaagcaatcctcccacctcagcctctggagtagctgggactacaggggcatgcaccaccaggcctggcttcctaggagggtctttaaagagaaaatatttgttcaattgaaaacaggattcttgtcatctacaactccaacacagcctgaaaatatccacattataacctggaccttagacctactttctccactatcctgcaaagctacatctgtaactacctattggctatctatatgagtcctcaagcatctcagactttacatgaataaaactcaacttccttcccattcaaatctgtttattttcttctgtaagagaaagataccatttgagactccagaatctgcctctaactctcaacaagactctgcaattactcaagtatcctttccatcctcattgccctgctgttattacataggccctggttcaagtccttgttacttgttcccattattgcaataacttctaattccaatgccgttgtgtgatcccattttaaacacggccagagcagtcttccaacaacatagctctaatctagtttcatccccacttttacatgcctcagtggctttcccagtgacttggcatggaacacgtcctcagttgccatacattccagctaactcttacccaacctttctttgttcacacagtttccttttccttcctcattgacccatccgcatctctgtttatccaagacttctctgtgatagctgacccttagtctttctctcccctattcctccagactagatcctgtctccttcctgcagccccgacacagccttcagttcatatcttttgcatgatgcttagcaccttctatccctaaggacaacttactcatttgagatttctggcagggtaccttgcatgcagtggacactcagtatttgctgaattaaattccttcctatggatcccttctgattttttttaagtgcctctaatacacatatcattctagggctcatgccacttttaatgtcattttctaaaggaaaatcttatctatgatattttcccttataagagatagttgttttgagtagggttttttaaaagataaaggtagtaggaaattttttaaagcctaaatatcaaattcctttccctttggagttgggggaaggaatgaagggggagcaacttgctctttcatatgagttggtcatagcatgtaagaaccaatcttgaaatatcgttttttttttaatggcttataatgtatttctagaaatactttgtacttaaaatgataacagtttgtatctttttgtccatatatactttataaataaaaaaattagcattgtaaataatgttaatatgtatttatacaaaataaatttactataatata

SEQ ID NO: 1247 - DNA, 2311 bp, Homo sapiens
ggcgagttgctaaggaaatgactgcccgcagcgcctggccccgccgcgcaggccgggcggggtctggagcggcgccgtttccgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgta

SEQ ID NO: 1248 - DNA, 3666 bp, Homo sapiens
gtgctcggcgctcccggggtgcctgctcggcgctccgccggccgccctgcgtacgctcgcaaggcgctcgcagactccggagtcgccaacatgtcgaccgccatgaatttcgggaccaagagcttccagccgcggcccccggacaagggcagcttcccgctggatcacttaggtgaatgtaaaagctttaaagagaaattcatgaagtgtcttcataacaataattttgaaaatgctttgtgcagaaaggaatcaaaagaatatttagaatgcaggatggagagaaaattgatgctacaagaaccattggagaaactgggatttggagacttgactagtggaaaatcagaggcaaaaaaatgaattttgatgagaagacccctgggccgtgttcagtggtctctcaggacggagggcatcatcctgcctcttaggttggctgaggcctgcgtgtggtgtccttagaaatgggcttcgaatagaagctccagccctgtgggggcgtctcctgggtagggagtggcgtcccgttttcccttaggagggtgtttctgcattgaacccctgagtgggacggcgttcccggcaaagctgggagggaggcgagcgtggggcaagacccttgtcttcgaggccggggccctcttgtatggggcggttttatgttgcagtcctctgatactttctgagttcaaagaggtaaatgtataaatttcagtcccttctgaacacagatatcatcagaaaattaccattccctagcaggatgttttcgtgtttgtattcgtatatgccagttcatttcctttgaaaaaaaaaaaaagtggaacacaaagtaggaagtgagaaccttctggctttggatggattgacttcttgattctttctggttttgcctgaacaccaagtagcttcataatcaaagggtcattttctggtttgtatcagaccgtatttataaagttgggtatttaatttcagtaactcctgtattttaacagaaaaagaacctgagtccatttgcagttaggctcgcaccagctgtcttctgtgccagccagctccgcccgagaccccggcacgtgttcgcagcacagcctggcaggggccctgagcggagttctcagcccgtctgtgccaaagttgcctgtgggtcacggaaacccggcccatgtccacccagtgcgtcaggccagccggggcccaaacctgtggatggaacgcaggtgcctgcacatctggggcctcagccagacctgtctccttcccaggcactgtcggaaaggggctggctcctgtctggtcagtggaggatggtggcaggagacggggtggggaggtccaggtcacgtcctctctggcgaccctggcagtggctgtctccaagccctggcaggtggggccaccaatctggccgacctcaggctctgggaaacaggctgccctcgtccctctgcctgtgggtggctgaggcttctcagcccatctccagttctctgcagcaaaggccctctgtttctgtcctgcagtggtggccctttcgtggttaaacatgtccctcccctcctcacagaactgagtacctattgcggctgggcccgcccaaccctgtgtccctgcacccatgggttctaccacctgattcggctgcagctgtcactgtcccgtgtctgctctctgtcaggcctctgagtgctgcagacgtattaacatatcaccgctagttgatggaaagtcttgtttcttattagaatattttgtgtaggcacagggttgccccagcactgtctatagcaaccccagtgtcctcacagtgcacgtgagccgtgacgcagccaccgtggagtcggcgctgacgcggtgtggccacgtgccatgagctcgccaacgcagtgcggctatatggcgtgagcttactgtgaagtggagacaggcagggacacaggaaactacaaacgagaaatccagaaggaggagctggaactgatgggcatagccggccgcgagcccctccgagcacccctgggggtggagttctggctgtcatggcagagggtttcacatgctcaaaaagtaaatgaaccaggatgtgaggggaacacaacagaccatgccgacggagctcccgggcccaggccggggcctcttcccatcgcactctgacccgccgtcgggagtgcccaggcccgggtcgggcctgcctctccgctcgcaccgcactctgacccatcaggagtgtggggaagaccgtcgaccaaaggtgggaaagacaggaaagatactgtactctaagtagtaaatttgttttttgcgtggacgattctgaagctgtattctgagatggaaaaaactagaaatacatcgtggatgatgagagccaggtgtattgagctcctgcttttctaacgtacaaaggtaactggatagagaaacggagtgatcgccctcacctggccagggtgtgctccgagaccccagcaggtgccgaagccgcggatagtcccgaatcctgtccaggcgctgttttttcctgtacgtacctgtgatcaagtctgagatgtgacagcaaaactgacagaacttcgtgcttccctcttcaaaatgtcacagatgggcactgtgttcttaccggagatcttagcaacctcggcatctggctgtttttcttataggtcaggagtttccaccttttcccttaaaggaagcgcttggcagcttctctggtgtgtctgagtcgccagcatcaccactgtcctgttctggggccattcttaagtaaaataaaagcttcttggacccaagcaccacatcaccgcgatggctggtctgatcaccgagatggctgctgagtgcctggcaggcagggtggcgtggatggcccgaaacgctggacggagggagggttgatgtcccagcaggacggctgctcagaacagcacagaatcaaaaactcatgaatggtttatttctggaattttccacttagtatttttggactgtggctgaccatgggtaactgaaaccgtgtgtaagggggactgttgtgaggggctgtgcacaaatgcttcccagctcttgagggcctggacgcagtgacccgtgcactcagggtcttggccctgataccattctgtaaccaaaaggaaccagggccaggccagagaaggtatcagatgagctagagagtgaagaattgctgggatgaggagacttgttgaaataacacggggggatgggaaggagcatacggtggccagcctggggcagtgtgagcgtgaaaataaacaggctgggcgcagcggctcacgcctgcaatcccagcactttaggaggccaaggtgggaggatcacttgaggctaggagttcaagaccagcctgggcaacatgggtgaaaccctgtctctacaaaacaagaaaagtcagccgtgcgtggtgtcacccgcctgtagtcccagatactcaggaagctgaggcaggaggatcacttgagccagaggttaagtctgcagtgagctgtgattgtaccactgctctccagcctgagcaacagagccggaccctgtctcaccaaaggaaaaaaaaaaaaaaaaaagaaagaaaattaattattgtaatgggctgtagccctcagaataaattgatatccagtagtctatacaacataa

SEQ ID NO: 1249 - DNA, 1605 bp, Homo sapiens
cttgtgggtggaaacgcgctggctgactggggtcggcgtttagttcagcgcagcgactcggggacctggagctgacgcctagacacttgtattagctttaatagaagagaaatggaggagccatagaatattaaggatgaattcaggaaggcctgagaccatggaaaacttgcctgctctctacactattttccaaggagaggttgctatggtgacagactatggggcctttatcaaaatcccaggctgtcggaagcaaggtctggtccatcgaactcatatgtcatcctgtcgggtggataagccctctgagatagtagatgttggagataaagtgtgggtgaagcttattggccgagagatgaaaaatgatagaataaaagtatccctctccatgaaggttgtcaatcaagggactgggaaagaccttgatcccaacaatgttatcattgagcaagaagagaggcggaggcgatccttccaggattacactgggcagaagatcacccttgaggctgtcttgaacactacctgcaagaagtgtggctgtaaaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaa

SEQ ID NO: 1250 - DNA, 2899 bp, Homo sapiens
ggcggtagcggcagcggcggcggcggcggcggcggcggcggcggcggcggcggcggcggcggcagcggcggcggcctgggcccgggcgcagcggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgca

SEQ ID NO: 1251 - DNA, 1760 bp, Homo sapiens
ggcatggcctaagccggtcagctaaggccatgttaatacggggctgtcccatctctctgcggggcgcgacagctggaagagccgaacggataagagaagaggagggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgagataaa

SEQ ID NO: 1252 - DNA, 7325 bp, Homo sapiens
ggaagcggaagtgaagggtgcgcttggcggcggcggcgggagctgcggagtcgggaatcaaaacaaagggcctggggggggcggggggaaggcggcggggccggaatgtgagcggaggtggagccggcggcagagggtggaagaatgaaagaaaagaaagatgaaaggatgttgaatcactttgcatggctgtatgatggaaggaaacggaactgagaactcctgcagtagaacacgtggatggcttcaacaagataatgatgctaagccatggctttggaaattctctaattgcttttctcgtcctgagcagacgctgccacatagtccccaaacgaaagagtacatggagaacaagaaagttgctgtggaactaaaggatgtaccatcaccccttcatgctggctctaagctttttccagcagtcccacttcctgatattcgttctcttcagcagcctaaaatacagctttcttctgtccccaaagtaagctgctgtgctcattgccctaatgaaccctccacttcgccaatgcgttttggtggtggtggtggcggtagcggaggtaccagtagcttgattcacccgggcgcactgttagactcgcaaagcaccaggacaatcacgtgtcaggtagggtcagggtttgctttccagtctgcatcttcactccagaatgcctcagctaggaacaatttggcaggcattgcaagtgactttcccagcatgtgtctagagagtaacctgtcttcctgcaaacacctgccctgttgtggaaaactccacttccagtcatgtcatggtaatgtgcacaagctgcatcagtttccgagtctgcagggctgcacctccgctggctatttcccctgttctgatttcacaagcggggctccagggcatttggaagagcacatttcacagtcggagctaacgcctcacttgtgcaccaactctttgcaccttaatgtggtacctccggtttgtttaaagggctcactttactgcgaagactgtctaaacaagccagcaagaaatagcataatcgatgcggctaaagtctggccaaatataccacctccaaatactcaacctgcacctcttgctgtccctctgtgtaatggctgtggaaccaaaggaacagggaaggagaccacgttgttattggcgaccagtctaggcaaagctgcttcaaaatttgggtcaccagaagttgcagtagctggacaggtgctagaaaacttaccccccattggagttttttgggatattgaaaactgctccgttccctctggccggtcagcaactgctgttgtgcaaagaatccgtgagaagttttttaaaggccacagagaagcagaattcatctgtgtatgtgacatcagtaaagaaaacaaggaagttattcaagagctgaataattgccaggtaaccgttgcccacatcaatgctactgcaaagaatgccgctgatgataaactgcggcagagtctccgcagatttgcaaatacacacactgctccagccacagtggttcttgtgtcaactgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccacagtgccacactctgctctatgtttataacctaccagcaaataaggatggcaagagcgtcagcaacaggctcagacgcctgtccgataattgtggtgggaaagtgctgagtatcacaggctgcagtgcaattctccgcttcataaaccaagatagtgcagagcgcgctcagaagcgaatggaaaacgaagatgtctttgagaaaaaagataaagaggagactgtattccaagtgagttacccgtctgcttttagcaagttagttgcatccaggcaagtcagtcctctgctcgcatctcagtcttggtcttctagagcatccccgcttgctttcaacattgcaaattcgagcagcgaagccgactgcccagacccatttgcaaatggtgctgatgtccaagtcagcaacatagactacagattatcccggaaggagctgcagcagctcctgcaggaagcatttgccaggcatggcaaggtgaagagtgttgagctcagcccccatacagattatcaactcaaggctgttgtgcaaatggaaaacttacaagatgcgatcggtgcagtgaatagcctccacagatacaaaattggcagcaaaaagatcctggtctcacttgccaccggggctgccagcaaatcactctctttactgaggtttggacacaagttgaatgtgtcagatctatataaattaacagacacggtcgcaatccgtgaacaaggaaacggacggctggtgtgtctcctacccagcagtcaggcccgccagagccccttggggtcttcccagtcacacgacggctcctccacgaattgcagcccaattatatttgaagagttagaatatcacgagcctgtctgcagacagcattgttccaataaggatttcagctttccagattgttacattgcagagtttggcgatctagaagtagtgcaagaaaaccaaggaggtgttcccttagaacacttcattacctgtgttccaggtgtaaacattgccactgctcagaatggcatcaaagtggttaaatggattcacaacaagcccccgcctcccaacactgacccttggcttctgcgttcgaagagtcctgtaggtaacccccagctgatccagttcagtagagaagtgattgacttgctgaaaagccagccatcttgtgtcatacccatcagtcatttcatcccatcctatcaccatcattttgcaaagcagtgccgagtgtcagactacggatactccaagctgattgagttattagaagcagtgcctcatgtattgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgtttctcaaaggactgggatgtcactgaatatggtgtttgtgagttgattgacatcgtatcagagattccagacacaaccatctgcttgtcccaacaagataatgaaatggtgatttgtatccccaaaagagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgagaccgctgcagccttcgacttgcaaatagaactgaagtttgctggaggctatagccttctcttggaggaaatccttgaatatatccctcctccttttctttctcctcttccttctttccttcctcctcctcctttcttcttctttgtcttttttgtcatcttcatcttcttcatctttgtctttgtccaattcgtcgtcttcgtcttctttatcgtcgtcttcgtcttcttcatcgtcgtcttcgttttcactaatgataagatggaagaatgtgtgaagctcacaagtctgtatttgtttgcaaagaatgtgcggtctttacttcatacttaccactaccagcagattttccttcatgagttttccatggcctataccaagtatgtcggagaaactctgcagcccaagacctacggccacagcagcgtggaggagctcttgggagcaattccacaggtggttgttcagtttctgcaaaaaaatggcaaagagctctcatgtgagaactaccttaatttatatgccaaagctggtcgtttgagttcactcagtctctcccctgccaatcatgaaaaccagccctcggagggcgagcgcatcctggaggtgcccgaatcgcacacagcctcggaactcaagcttggagctgacggcagtgggcccagtcacacagagcaggagcttctccgcctgaccgacgactcccccgtcgacctcctgtgtgcgcctgtcccctcgtgcctgccgtcccctcagctgagaccagaccccgttatcctccaatctgctgatctcattcagtttgaggagcgccctcaagagccttctgaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcaggttggaatgtgaaggttcctggcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaacaaagtaataataattggtgttgagaacatcagttgccttattctaagatttcataaggctgagtttgcacgcttggacttcagttctgctagcatgtaaagagtggtggactttaaaaccgtaagaggtatcattacaagtcacctggaacagactcaaagaacaggttctttgggcaacagacaaagaagaatcaagttctgtgctgtcccgtgagtgtgtctgagtaccattcactggagttgctgcttaggtctgggacgtgtgtgtgactcttaacaattgctgtctgaaaatgagagagaagacttcggaagcacattgtgttcataatgtactccacaatggccagtccaattgctatctatttttttatccagaggcttaattaaatgatgtggtaaaatgatgtttgagcattaagacaatgtaattctttatttctgggtggaaagatataccggattaaatttatctgtttaaaaaaatgacaaaagttatcaccaaaaccccctttcccatcttgcactgtttgttttggattgggtttgggggaaagagatgtttttcttagttgtctactttgtttgaacacttttgttgtggttcaagtgctgttttgtgtgttgggaccaaacagttgtcaataaactttacaagcgagcatct

SEQ ID NO: 1253 - DNA, 7900 bp, Homo sapiens
gacggcggctcggcgatggctctcccgcaggcgcagaaacggctgctgggcagctgatgggcaggagcttaccaggctggcttgctctgagctgcggttactgtgtccaggccccgggttctcagaactgtcatacataaagtacacagaaatgaagagaaaagtcgtgaatactcacaagctgagattgagtcctaatgaggaagccttcattttgaaggaagattatgaaagaaggcgaaaactaagattgctacaggttcgagaacaagaaagagatatcgccttacagataagagaagacataaaacagaggagaaatcaacaatttacacgtttggcagaggagctaagggcagaatgggaagaatcacaaactcagaaaatacagaacttggaaaaactgtatttggcaagtttaagaagtatgggagagggacatcgacaggccaaagaaaatgaacctgatttggatgctttggcacagcgggcagcagaaaggaaaagaaaagcagatttgaggcataaagaagccttgaaagtacagaaaaatcaaaaagaaatattactgaaacaaaaaacctggcatataaaagctcgaaaggaagcactgcttgtggaaaaagagagatcagccaaaattacaagtctgccacctcctcctccaactctttttgagaacatcgaagtaaaaagaatttctgcagtcaaaaccaatagttctacctaccatcatcttcacacttttgtgaatagagagacagacacaaaacggccagatgctcgtttggctgctgaagaggaagctaaacgattggaagaactacaaaaacaggcagcacaagagagaatggaacggtttgaaaaggcacatgtacggggattccaagcaatgaagaagatccatttggctcaaaatcaggagaaactaatgaaagaactcaaacagctacagcaagaggacctggcacgtaggagacagactgtagcacaaatgccaccacaactagttgaacttccatacaaacgcagtgaaatgaaagaagactggcagagagaattggaatttgcctttgaagatatgtacaatgcagacaggaaggtgaaagggaatctgattctgcaccttgaaccagagcccttgcccactgtgactaatcagatccaagatgaagagctggacctttcaatggaacaagaaaatttgggtgcagctgaagaccttccagtgacagaagctgaaatatgttctagtgaaacagatgttcccttggtaatgaagacccaacagattccttcaaaagttctttttaaaaaattattaaataagatccgaagccaaaaatctctctggacaattaaatctatgtctgaggatgaaagtgaaatgattacgactgttagtgaaattgagagtaaagcaccaacggttgagtcaggaacaattgccagcaaagagagaacgttatcctctgggcaggaacaagttgttgaaagtgatacactaacaattgagtctggaccacttgctagtgaagataaaccactttcgtgtggtacaaactctggaaaagaacaagaaataaatgagactctgcctatcacaactgtagctcagagttcagttctacttcatcctcaagaagcagcagccaggattagaatgtcagcaaggcagaaacagataatggaaatagaagagcagaagcaaaagcaattggaattacttgaacaaattgaacagcagaaattaagattagaaactgactgcttcagggctcagctggaagaagaaaaaagaaaaaaaactcaaccgactggggttggcattgctccagcatcatgccctgtaatttctgatgaagatagtcataggcagatgattcgtaactatcaacatcagcttttacaacaaaacaggttacacaggcagtctgttgaaacagccaggaaacaattacttgaatatcaaactatgttaaaaggaaggtgcccatcggtgtcagctccatcattgataactgattctgttatatcagtgccatcatggaaatctgagagaccgactgctatatcagagcattgggatcaaggtcagagactcaagttgagtcctaacaaataccaacccatacaacctatacagacctccaaattagaacaagatcattttcaggtagcgagacaaaatcactttccacaaagacaggtggaaacaacagaaacattacgcgcttcagatattttaaccaatcaagctttagaatcacaagaacatctaaggcaattctctcagactgaaacacaacagagagactataaattggtccccaaagattctgagacactttcaagggctttgtcacatgacaggcagctaatatcacaggatgctagaaaaatatctgaaacatttggggcaacaacttttcaaagtttagaatcccaacaattgttctcagagaatagtgaaaatatatcttaccatttaactgaaccttcttcatttgtaccactggtacctcagcattcttttagttctctgcctgttaaagttgagtcaggaaaaattcaagaacccttttcagccatgagcaaaagtacagtttccacaagccattctataatcagccaaatgcatgataggcctttgctgccgtcagagaatatcacagcccagcaaggtaatatgaaggccctccaagaacagttagacctacagaagaaagttcttcaggcaactcaggaagctcaggaacagttgcttttgtgcaaacagaaagaagtggaacagcaaacgggcctctcggtattccttcccttggtaactccagattcatctgctttattgccttctgccaaagcagatttggggagaatccaggaatcttcaccaaccaagaataatattgcagtttcctcagaccatcatgtgatctcacaacttcaggataagcgtttgagtctttcacagcctatcctatcacagcaaaataattttaaatttctccaagagcagttgaatattcagaaggatagccttcaggctaggcgagaagcccaggaagtattgtatgtacataaacagagtgaattggatagaagagtatgttccgaacaggctgagccctctttcccatttcaggtagctcagcatacatttacttcactaccatctgctgatacaaaatctggaaaaatacaggagcaacattcatctaagagcgagaaaggacttgtttcatgccaatctgacatccccatatctcaggatgggtctttgagtttcctacagcagttcctacctctacatgatagtttgaagttgctccaagaacagttgactaaacagagggatactcttcaggctaggcatgaagctcaggtggaattacttttacatagacaaagagatttgggggacagtaagtctgggctggtgagctcttcatcctcaccagtggttgttcagcattcagttgcttcacaagcttctgctaaagctgagcctaggagaattcaggagctttatttatctgagaaggagaatgtaggtccctcctgtcatttgataatcccaacatttcaggataagtctcttagttttccacagcatagcctggcacagcaagaaaatttgacaatactccaagaacagtcacaaatacaaagggtaatacttggtgctaaagaaggaactcaggaatttgtacacacagaaagtgaattggagaaaagaatttcttctgaacagactggcacctcctcatccctttcccaggtggatgaatctgagagattccaggaatgtatatcaatcaagagtgacagtaccattcccttaagccatcctaagatcccaagatgtcaggaaagacttttgagagtttcacaacatatgctacctctacaagataatttggaggaacaccaagcatggctagacactgagaaagaagcctttcatttcagccagaaaacccaagaaaatacatcttctgaacaaactggttcatcttcattcataccccagttggtacagctttcatttacttcgttagcttcagctgagtctggcacaatcctggaacctctttttacagagagtgaaagtaaaattttttcaagccaccttcagatcccacaattgcaggataggcttttgaggatatcgcaacttatccagcctcaacaagataatttgaaggcacttcaagaacagttagctacacagagagaagccatcattctagctagacaagaagctcgggaagaattacttttacatcagagtgaatgggagggaagaatatctcccgagcaggttgacacctcttccttacccctagtaccacagcattcattcgcctcattacctcttaatgaatctgaaagaaaccaagaaccatgttcaattaacagtgataatatagtatcctcaggtcactcagagataccaacattgcctgatgggctgttgggtttatcacatcttgttttacctcaacaagataatttgattgcacttgaagaacacttgcatgcacagacagatttccttccttctattgagaaaacccagaaagaattggttttgtcaaaaccatgtaaatttgaggaaaaggtatcttctgagcattttatccagtctcaccatggtgatttgcaggcacttcaacagcagttagatacacagaagaaagccattcgatctatacaggaagtccaagaagaattgcttttgcaaagattaagtgaattggagaaaagggtatcatctgaacaagtttgctcctcttcatttgtatcccaggtgcctgttgctgactctgaaagaacccagaagtctttcccaaccaaaagtaatgatactcttccctcaagtcatcgtgagattccaagattacaggatagacttttgagtttatcaaagcctattctgcctcagcaagataatatgacagcacaattggatgcacaaagggaagtgatgtattcttatgagaaaccccaggaagaactgtctttaaacaaacaaagaaagttgaacaaaagtgaatctgctgagcatactatcccctctttgtttctacccaaggaaacagagcattcgtttattccactaccttttgcagaagctaaacctaaaagcacttgtgaattgtattcatcccagaatgaacatgcagcccccccaagtaatcctgtgatcccagggtttcaagatagacttttgagtttttcacagtctgtcttaactcagcaagataacttgggacttcagaaacagttggatctacaaagagaagttctgcattatagccagaaagcccaggaaaaattgcttgtacagagacaaacagcattgcagcagcagatacagaaacatgaagagactttgaaggatttctttaaagacagtcagataagtaagcccacagttgaaaatgatttaaaaacccagaagatggggcagctcagagactggtttcctaatacacaagacctagcaggaaatgatcaagaaaatattaggcatgcagataggaacaactctgatgataatcatttggcttcagaagatactagtgccaagcaaagtggtaaaccaggtatttatgaagacagagaccccctgcgagtctcaataagccgagaacaaagtttctttgggagcccactggcccatgatccgtttagttgtcttcaactggttggccaagagaatgtctgtggtgatgactatgatgaagcagttaagctgaaggaatctgttgttgaaaatcatgcagtgttaagttatgctgtggaggaagaacatgcatatttgggtccaactgtgaagccagatgataaggctaaaacactgtcttatgaaccattatcttcagcaactgtttccactgggagccttttaagttatgaaaacacagatttgagccttacagatccagagtcattttcagagcacatggatgatagcaagcaagaatctaccaccagtaaagaagaggaaacaaatattataagttccatagttccttcaacacaagatatttatcagcggcagaactcttcagacgttcataaatctctgttgcctgcagtggatgaaactacatgtggtcacacacactttcagcaaatgatagacaagtacattaatgaagcaaatttgatacctgaaaaaacagatttgcaagaattggaacacatttttcctaatttgcatcatcagctgtttaaacccttagaaccacatccagattttgacttatcatcatcatcctctgggatttctccagacaacagagacttttaccagagatcagattcttcatctgaaagccactgtgctactggattatccaaaagtacagtttatttcacagcactgaggaggaccagcatgcattcttctcttaacacaagtccgaatcaacaacctgacactaacttggctcatgttggagctcacagttttgctacagaaaatattattgggggatctgaacaatgttttgaacagcttcagccagaatattcttcacaggaggagagccagcatgctgatctaccaagtatttttagcattgaagcaagagattcttcccaaggcatgaaaaatcagaactatccctctgaagaacatactgaaatattacaaaacaagaaaaaaattgttcatttccagctttctataggaaacttaagttcagtctacagttcatctgatgaagctaatgtatttgatcagttaaatgtacagcatagcactccatgtggttctaactctagtgagtgctcaacaaaacaccaactagaaagcagaaaggaaagtatgggctttgaagaactatcaaaaagaggggttgttacaatgttacaaagtcaaggactcattgaagataataaaaatgaaacctgtagggttttagacataaatccacaggtagaggaaactgactctcgattatgtgtaagaacagtggagatgggaacttcaattcaggcaccatattccttaactactcaaaatgaaaaatattttgagaattcagctgaaacagacattccaaaaatcaccaaaaaactatctcaactaggagaatcagagctttttgcaagttctggatcattttcattacagagctctataccagtctgggaaacagaaactggccatggtataatggaagaaccagaacttactttaataagcaccactgataccagtattgctgaaatggattttgcaaatttaaccctagaagagaagagcgagaatgaagcaaaatgcttctttcaggtgagtgagtttctgcctcttgtatcagcaacagaagcctcagattatccagctgtatcagaactttccatagaaaaaccaaggacagcatctacagaaacccctcgcaggcttacacctgtaccagggagcttacaagaagcatttataaagaggaaaaaatcatttatggagagatcccaccagaggcagaaagaaataaggaataaaattcatgtctctgaaaattctcaaatcaaaacagttaaagagaaaccatctataagttcatctgtgagtcgtctaaagggcgtgaataaagtcagagcatcttttcctgaagacagaaagactacacaggctctaaggcaccaaaggggtctaaggttatacaatcaactagctgaagtgaaacaacaaaaggaagaaaaaacaaaacaagaagcttatgcccaaaacagagcaagggcaaaagaattccataagaaaacactagagaaacttcgagccaaaaatacatgctgactttctagaaatagtgtaaaggttttttaattgtgtatatgtagcattagacaaaattatttaaagtcaataaattgttattcgagg

SEQ ID NO: 1254 - DNA, 899 bp, Homo sapiens
accggggagccaggtaccttccgcgagacgtcgaggggcgagtcctagtctcttttctccgcactggaagacttgaacacttccttctctgcagcaaagcacctgctctgagtggccatggggaagcgatacttctgtgactactgcgaccgctccttccaggacaacctccacaaccgcaagaagcacctgaacgggctgcagcacctcaaggccaagaaggtctggtacgacatgttccgagatgcagctgccatcttgctggatgagcagaacaagcggccctgcaggaagtttctactgacaggccagtgcgactttggctccaactgcagattttcccacatgtcagagcgagacctgcaggagctgagcatccaggtggaggaggagaggcgagccagggagtggctactagatgctcctgagctccccgagggccatctggaggactggctggagaagagagccaagcggctgagctcagccccaagtagcagggctgaacccatcagaaccactgtcttccagtaccccgtgggctggccaccagttcaggagctgcctccatccctgcgggcacccccacctggggggtggcctctgcagcccagagtccagtggggctgagccccttgcccccgactgacccccacgtggtcacttttctcatcagtcacaataggaagccaagcccggttcctgctacgccccatggaggctccgagaccatctgcccagcctcactgaggctcaggacacggccacaccaagtgcagccctcgtcctgggtctgcaccgggcagctctcccctcactctcctccacctgcccccctgcttcttaagaagatgggggagaaaacttccaaatgtttataaagaaagtctgtcaccaca

SEQ ID NO: 1255 - DNA, 4808 bp, Homo sapiens
aggttcaagtgcgcatgtgcgcgaggagtcgctcgggcacttattgagcgccgactgtctacgggcggccgggggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaaaaaaaagagtttctggctgatgggtgactcagagtgcaggactgcctggccgtggggcagaggggtttgcccttctcggagggtacctcctgttccctgtctgagcatcctgcatggaagtcaaaggaaatccctttcttggtgacgacttaaatctgggttccctcagacattgggttgcaccccaacaaatattaaatggcttcttcttaaagcccagagaaagaggttttttaaaagactgtcgccaaatagctgagccaaaaggctgatcagaattcactttttggaatgtggcagttaaacactaccttgatcattctctcctctttcctcgaggaactcctggagggtttgagcgtctggaaactctctgctctgacccgaggaagcaccctcctgacgccgccttcctccggttattgaaaggacgcctcagaaatgctttgttttcttttacgatgtattcagaagcctttactgattaaagttttcttttatttgggtggccgggagagacccagggaggttctggaggttcctttctgtctcctggccccaccagggatttccccatttctgtttgctgcctgaaagcaggatgaggaaggccaaggagagtccttgcacccgtgagcgtcaggatgaggaaatgacaggaggaagacgtgggtttgggttagtggctgctggcgttttggcccttggtgtttctggagcctccagggatctaggggagcctgggctgcgtgcatgtcgataagcagagctgttcttggggagaaggagggaggtctcgggagtgtagcaccatgccaaccagccctgcgcgaagacagagtgagccacgcccggatggcagggcatgtttctgttttggtgtctcactttcctcccagcgtgacttatttggggattcctcagggcctactggaatgtgactgcccactgcccagctgcctcgggtacaagtcctggccctatgtcccagctgtcaggggctcagggaatcctacccagccacctgtcctgggatggagtgtcagcatccaccccttggttgtcatcgaggccgccctcccagtcctgggtgaagatatttgggccaccagggctcccttggccccttcacgtaggaaatagacacgtgctttttaatgcaggacactttgagtgttacaaaatctgtagacctggcagtagggtcatgatgttgggaagggtgtagtgccctaggttggtgacagaagggacagacacttgtgcacaggtgtctttggtgatggggtttttttttttataacttagtaaaaaaaaaaaaatgtatgtggaattctgtctcttggtaaagctcaaagccaggctagcctgaggtggcgcagggctctccttcctgtcccttcgatctccttgagaattaagagctggcagctgctgatggtgtttcccaacccccctcacttcccaagacaacccccagcttcaggtcctcatggggaggggagggcacgttcttgacacatgggaacttcgctcaggagggcctccccttcccctctccctcagagttttcactgccgtctcgtctttagaaagctgtttgaattccccccgcccccagtttggaccgtgtagatataactggatatacggatttttctctttgtgcaggcttcttatgccgttggtatacagggcaggaaagagaggaataaagggagagagcagtgtggaaaccacggtggttttgctttgttcttactaggttttggtgccaccttccctgcctgcgcttgtgccccctctcctccttggcactggcggcctccttgcctcccttccacccgtgctgccatcccgtgcctgtcgtgttggttcttcacacgtgctctgttctcggggttgttccattcatgccttcttggagggtgagggtggcttgggaaccgacccagtgatcatgcctactttcttctttgtatctccctccttcccagcccacccgggcagcagactctgatggaaggaaggtgccgtaggtgggcttttagaaactaacgggactggttttcaaagcagttatcttgggaaactgtttattccagcgatgtgacttttttcagaatatttcttggaatcatattcagagtctggggctgtgtgttgagcagccttaaggatgctagacactcatttagtgcccagggagtccagcgaatgacgtctgtggccaagcgaggtctcaggtgcaaagcaaaaggaccatttaaagtaaaatagcttggattcaatcatgtgacttttaaattggctcagaaagcaattttgtaatttcagagagtgttttgagccatggccacgttgtcattgtgagtctatagcttgactccttggagaacaatattcatttggttgtggagactgatttgctgggagaaatctgtcctgttactttctggtcatcccaggttctgacttttaccaggggcaaaaaaaaaaaaagcaagagggagataaatcccatctgtgagtttgtcttattggcgcctttttcctcagctgtcttccaagtattatttttactgttaaaaaattttttaaaaatgtgaaatgtaatgtttttacagcaacaatatgaaatatattttataaggaataaaatggtaccttgtctgatttaa

SEQ ID NO: 1256 - DNA, 1485 bp, Homo sapiens
gagcccgagcctagtgcctcccacgcccggcggccgcgagccggggtccgcgagggcggagtggggcgcggcagccaggaacccgactacgaatcccagggtgcgggcgggcggagcgaggagggacgctgggcctgcccggtgcgcacgggggcggggaccggcaaggcgggaccatttcccggcataggctccggtgcccctgcccggctcccgccgggaagttctaggccgccgcacagaaagccctgccctccacgccgggtctctggagcgccctgggttgcccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccaccatggggaatgggatgaacaagatcctgcccggcctgtacatcggcaacttcaaagatgccagagacgcggaacaattgagcaagaacaaggtgacacatattctgtctgtccacgatagtgccaggcctatgttggagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctggccgctccgggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagtttaa

SEQ ID NO: 1257 - DNA, 2189 bp, Homo sapiens
cggggtcggtaaggggtgcggcaatgctgcaactgcgggactcggtggactcggccggtacgagccccacggcggtgctggcggccggcgaggaggtgggggcaggcggcggcccgggcggggggcggccgggggcggggacgccgctgcgccagacactctggcctctcagcatccacgaccccacgcgccgcgcccgcgtcaaggagtacttcgtgttccggcccggcagcatcgagcaggcagtggaggagatccgcgtggtggtgcggcccgtggaggacggcgagatccagggagtgtggctgcttaccgagcgagaaggttttgggattcgaattcagtgggacaagcaaagtcgtccttccttcataaacagatggaatccctggtctaccaacgtgccctatgccactttcacagaacacccgatggctggcgcagatgagaagacagcatctctgtgtcagttggaaagcttcaaggctctgttaatccaagctgtcaaaaaagcccaaaaagaaagccctttgccaggacaggcgaatggcgtgctgatcctggagcgccccctgctcatcgagacctacgtgggactcatgtccttcattaacaacgaggcgaaactgggctactccatgaccaggggcaaaataggcttttagccgctgcgttctgggagctcctcccccttctgggagctcctccccctccccagaaggccaagggatgtgggggctgggggactgggaggcctggcagtcttcatgctgccctgctgctgctggaaggatggggatctttcacctttagggatctcagcacaattagaatcgtaaagtgaattctatctatttaattggatattggactctgctcatataagctacagacaaaagccaaaagactctcgctgtccctgtgctgctggtatttcattctctgtaacttcagttctggtgttttccttgagtatctacttggcttctcgtggtttttcccaccccagctgccccagcacgcgggacccatagcacaccccttagcgcttgcctaggttgctgaaaacagggaggcacctggtatctcgagtgcctgcagttgcaagtatgtttacacctggtgtccaattttgtattttaaaatgtaatccatttttacttcagctcatccaaaagcagccagcagaccggttgactgagaccggtctgtggctgtgggccccttggtgacccgctgctcttttggaaatgggtgacctgaagtgacactttttccacaattaacccaagttgtgttaatacttcaggtctgtttcccagacccagaaagctttacagaaaatcattgtaagacaatttattaatttgagaaagtcaccttgacagttctttgcacacaagttttacacctctctggattcgaagtttgtattgtattcatagttaaagggaatcgggtactttgcttgttgaataatgcactttaaaacaaggaaccgtatcaggccagcatggtggctcatgcctgtaatcccagcattttgggaggctcaggcagacaaatcgctctagctcagaagttgcagagcagcctgggcaacatggtgaaacccgtctctaccaaacagacaaaaagcagccaggcgtggtggcacatctgtggtcccagctacttgagaggctgagccaggaggatcgcttgagcccaggaggcggaggttgcagtgagctgagatggcaccacttattgcactccagcccgggcgacagagcgagactccatctaccagatccttatgacgcagctgatgcctgccttggttcctaccactctggtgtagacagaggactttgtccaagtctcacactaaacatgcccgggcttcgatgtgcctggaggatttccccacagggacccacgcacctccctgtatctgcgcagcttgctcgtgtggctggaagcgctgtcgataagcttcacgcactggcttgccagttcttcagctctaggacttgtagctttaagcaaacggtgtggcatgggttgagtgtggccacctgcaggatgtgcagggctgcctcagaagctggctggggactctagcctctgtgttcataaagacattaagaagtggatggatgttgttccttttttgaagttgtcattaaagtaggtgcaacaaccaa

SEQ ID NO: 1258 - DNA, 1592 bp, Homo sapiens
gtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaaaataaaatatgatttgtgttcatgt

SEQ ID NO: 1259 - DNA, 5356 bp, Homo sapiens
ccttaattagaaatgcgttagcgaatattatacgcttatactatgggcggacgggtggagagccttaaaaacaacaacaacaaactaagcagttgctcaatcgttgattgatcctcaggcacgtctagattttcccacttacataggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaa

SEQ ID NO: 1260 - DNA, 3893 bp, Homo sapiens
ataaggctacggatgggcgggacggagcagcccaccgcaaagtggcggtctacttgaggcggttaccttagtactccgagtagactgagtctgtggcgagctgcgggccgattcctggccagtgccatctcagccggagcaggcctcggggcctcagaagcaggcttttatctggcccgaggctcccagccgttcagcgcgtcttcccataacctataccgattattgggactctcggctgcagacacaggagtcacagatgctgggaagtatggcccgaaagaaacctcgaaatacctcaaggttgcccctggctttaaaccccctgaagagcaaggacgtgttggcagtgctggctgagaggaacgaggctatagtaccagttggggcatgggtggaacctgcctcaccaggtagttcggaaatcccagcatatacatcagcatatttaattgaagaagaactaaaggaacagctaagaaaaaaacaagaagctttgaaacattttcagaaacaagttaaataccgagtaaatcaacaaattaggttgagaaaaaagcaacagcttcagaagtcttatgaaagagcacaaaaagaaggctccatagccatgcagtcttcagcaacacacttaacttccaaaaggacaagtgtttttccaaacaatttgaatgttgctattggaagttctaggttacctccttccctgatgcctggggatggaatagaggatgaagagaatcagaacgaattattccaacaacaagcccaggctcttagtgaaactatgaaacaggcacgtcaccggctagcatcctttaaaaccgtgattaaaaaaaagggatcagtgtttccagatgatggaaggaaaagctttcttaccagagaggaagtgctttccaggaaaccagcatccactgggataaatacaggaataagaggagagttgcccattaaggtccatcaaggtcttttagctgctgtaccttaccagaattatatggaaaatcaggaacttgactatgaggaacctgactatgaggaatcttcatctcttgtaactgatgagaaagggaaagaagatttgtttgggagaggccagcaggaccagcaggctatccattctgaagataagaacaaacctttcagcagagttcagaaagtaaaattcaaaaatccattatttgttctgatggaagaggaagaacaaaagcagttacattttgagggccttcaggatattctgccagaagcccaggattattttctagaagcccaaggtgatttgctggaaacccagggtgatttgacaggaatccagagtgttaagccagatacccaggctgttgaaatgaaggttcaggttactgagccagaaggccaggccattgagccagaaggccagcctattaagacagaaactcagggtattatgctgaaagcccagagtattgagctagaagaagggagtattgtgttgaaaacccaggattttctacccacaaatcaggctcttctaacgaaaaaccaggatgttttactcaaagaccactgtgttctccctaaagaccagagtattctactcaaatatcaggaccaggacttcctacccagagaccagcatgttctccacaaagaccaagatattctgccaaaatatcaggaccagaattttctacctaaggaccagaattttttatctagagaccagcatgttctccccaaagaccaagatattctgccaaaatatcaggaccagaattttctacctaaggaccagaattttttgtctagagaccagcatgttctccccaaagaccagaatattctacctaaatatcaaggccaggattttctacctaaagaccaggactttttatctagagaccagcatgttctccccaaagactggaatattctacccaaatgtcaggaccaggattttctacccagagaccaaggtgttcttcccaaagaccaaaatattctacccatatgtcaggaccaggattttctacccagagaccaaggttatcttcctaaagaccaaaatattctacccatatgtcaggaccgggattttctacccagagacctgcatgttctctccaacgaccagaatattctacccaaatgtcaggaccaagattttctaccaaaatatcagaaagtacactttaaggagccatactctgatatgacagatgagaaagggagagaagacttttctctggcagactatcagtgtttgcctcccaaatcccaggaccaggatgacatcaaaaatcagcaacctgcatcttttatgagagaagaaagagtgagagaagaattgcctctggactatcatcaatatgttgtacctaaaatccaggaccaagactcccctagagaacagaacaagcatatcaaactaccctcatcttttgagaaatgggagattgcaagaggaaatactcctggagtgcccttggcttatgataggtatcaatcaggattgagcactgaattccaagctccactggcatttcagtctgacgtggataaagaagaagataagaaagagcgtcaaaagcagtacctgagacatagacgacttttcatggatattgagagagaacaagttaaagaacaacaaaggcaaaaagaacaaaagaagaaaattgaaaaaattaagaaaaagagagagcaagaatgttatgctgcagagcagaggatcctaagaatgaactttcatgaagatccatattcaggagagaagttgagtgagatattagcccagttacaacttcaagaaataaaaggaaccagagaaaaacaacagagagaaaaagaatacctgagatatgtagaagctttacgagcccaaatccaggagaaaatgcagctgtataatattactttacctccactatgctgttgtggtcctgatttttgggatgctcatcctgatacctgtgccaacaactgtattttctataaaaaccacagagcatatactcgggcactacattcattcatcaattcctgtgatgtccctgggggtaattcaactcttcgagtcgcaattcataattttgcttctgcacacaggcggactttgaaaaatctataataagaatctgaaattaactggtagtattttggcttttacttaaaatcatccctgagagagtatttaagaaaagctgttcaagttataaaatatataatctgggaagaaatactgtctcatataataattagattgtaatcattgttttaatctctgtctgggaaccaagattgaaagctgacttacttctctcttctgtcttgtgaaccatacggagcctattattttaaaatatgatcagacaagtaaggcttctcttactttgctctgctctgatcagaagagctcatgtgaagtctttgagattctcttatttatcatctttctaaaactgtgtttttgagcttgacagtactgaaaatgtctggatgaagcagaaaagaaagtgatgaaatgtgtttctgagcatcagagaccatctatattgccattaccttttctagttgtatataagaattcaagattagaagaatttagatttgttgcacatttttttcctcagcattttttcctcttgttttttaaaatgtattgcctctttccccattcagtgacactggacataggaatttttaattgtgtaattttctgttgcaaaaagggtaaataaatcctttgtcttttgaatatcttctatgtgaaataattgtgagtgacatttgaaaaagtgaatctgaagtcaaagtgagtaaattccttatttccctattttttaaaaacctggtatatgacatggctacagggcaaatgaaataaaaattgccatagttggtatgaa

SEQ ID NO: 1261 - DNA, 1852 bp, Homo sapiens
gagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagggatgccaagggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaattttgatcactttgggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 1262 - DNA, 1678 bp, Homo sapiens
ctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaagggtctgcaacttcattcttgaagtcagtgaggccaagaacccatcaattccgtacacattttggtgactttgaagagactgtcacctatcaccaagtggtgagactattgccaagcagtgagactattgccaagtggtgagaccatcaccaagcggtgagactatcacctatcgccaagtggcctgattcagcaggaagcatctcagacaccaaccactatgctgtcagcagttgcccggggctaccagggctggtttcatccctgtgctaggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctgagggggtgtctaggtgatcatttggatctggaggcagagtctgccattctgccagactagcaatttgggggcttactcatgctaggcttgaggaagaagaaaaacgcttcggcattctccttaggacttatctgcttgtagatttggctgatccaattaacatgtggggttcttggtgtgggtctggggagctgaaggattttatggagctggtgctttggaggaatcttaagggaaaggagtagaagctcaggcctttgaaggatttcagctcctcctctctgtaatttgtgctttaagcattttttttcctaaaataaactcaaatttatcctcaa

SEQ ID NO: 1263 - DNA, 1187 bp, Homo sapiens
atgaggtttgatactttatgggaaaacaaactaatgcagtccagggcagtagatggatttcattcagaagagcagcagcttctactgcaagttcaacagcagcatcaaccccagcagcagcagcatcaccaccatcaccatcatcagcaagctcagcctcagcagacagtacctcagcaagcgcagacccagcaggttcttattcctgcatcacagcaagccacagcaccacaagttattgttccagattctaagttgatacagcatatgaatgcatcaaacatgagtgctgctgctacagctgctaccttagcactccctgcaggtgtgactcctgttcagcagatattaacaaattcaggccagcttcttcaggtggtcagagcagccaatggtgcccaatatatctttcagcctcagcagtcagtggttctacaacaacaggttataccacaaatgcagcctggtggagtacaagctcctgttatacagcaggtgctggctcctcttcctggagggatttcaccacagacaggtgtcatcatccagcctcagcaaatcttatttacaggaaataagactcaagttatacctacgacagtggcagcacctacaccagcccaagcacagataactgcaactggccagcagcaaccgcaggcccagcctgctcaaacacaagctccattggtcttacaagttgatggaactggggatacatcatctgaagaagatgaagatgaagaagaagactatgatgatgatgaggaggaagacaaagagaaagatggagctgaagatgggcaggtggaagaagagcccctcaatagtgaagatgatgtgagtgatgaggaaggacaggaactctttgacacagaaaatgttgttgtatgccaatatgataagatacacagaagtaaaaacaaatggaaatttcatctcaaggatggcattatgaatcttaatggaagagattatatattttccaaagccattggagatgcagaatggtgaagagttgctttttttcttttataaataaaagaaacttaaaaaaaatgtaaagcggacagtttgaaacttggggcatatgccaaccaaaacttcgtttctgcatgtcagaaaagtgcagtagaagcaaagctactggaacaaagatagaccttgacaacatagacactacttac

SEQ ID NO: 1264 - DNA, 561 bp, Homo sapiens
gcagtcgctgccgaccggctggctgggccttgcggcgtgaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacaggaataggagctcggtgaattcaaggaccatgcttgcttcgttcattgtatcttcagcacctagcacagcacccagcacataggacatgtttgttgactgaatgcgtatctctatcatcacactcactcaatggtgttgagatatttgtgtttccccttccctagacagtgagatccttgaaggcagctgccttatcttattcctttttgtatttccatacctagcctaatacctagcttatataagggaacagaataaatgaacaataaagaaaagtctttacagcctct

SEQ ID NO: 1265 - DNA, 892 bp, Homo sapiens
gtgcgcactggcgtgcgagactcggcgggcgctgttgagggagtcgggccgcgactgtggtcgtttttataccttcccgcgcggacgccggcgctgccaacggaagggcgggtagggcggtgcgtgattaggttggcgaagagacggagtttcgtcatgttggccaggcccatttgagatctttgaagatatcctcaacgtgaggctctgctgccatgaaggtgaagattaagtgctggaacggcgtggccacttggctctgggtggccaacgatgagaactgtggcatctgcaggatggcatttaacggatgctgccctgactgcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcggtgtgttttgatatgaaaactctcatgaataaacatctccgtgaaacgccaaggccctcgtcaaaccctgagtcatgactgggaggagaaggagcaggatcagacggtagagcctggggcatgctcttcaggcatgctcttgcctgctggattgccggcggcggccctgggaccctccctcagg

SEQ ID NO: 1266 - DNA, 1038 bp, Homo sapiens; identical to SEQ ID NO: 788

SEQ ID NO: 1267 - DNA, 2470 bp, Homo sapiens
aaggcggagcggtccctgcaacccggccggcgggaactgccttctagtttttagtctcagaccagaccaccgggcgcaccccgatgccgagcccgcagcttctggtgctcttcggcagccagacaggcacggctcaggatgtgtcggagagactgggtcgcgaggcccggcgccggcggcttggctgccgggtgcaggccctggactcctacccggtggtgaatctgattaacgagcccctggtgatatttgtttgtgcaactacaggccaaggagacccccctgacaacatgaagaacttctggaggtttatattccggaagaacctgccctccactgccctctgtcagatggactttgccgtcctgggcctcggggactcctcatacgccaagttcaacttcgtggccaagaagctgcaccgacggctactgcagcttgggggcagcgccctcctgcccgtgtgcctgggcgatgaccagcatgagctggggcccgacgctgctgtggacccctggctgcgagacttgtgggacagggttctggggctgtacccgccgcctccgggcctcactgagatccctcccggagtccccctgccctccaagttcaccctgctgttcctccaagaggcacccagcacgggctctgaggggcagcgggtagctcaccccggctctcaggagcccccgtcagagtcgaagcccttcctagcacccatgatctccaaccagagagtcaccggcccctcccacttccaggacgttcggctgattgagtttgacatcttgggctctggcatcagctttgctgctggtgatgtggtgctgattcagccctccaactcggctgcccatgtccagcggttctgccaggtgctgggcctggaccctgaccagctcttcatgctgcagccgcgggagccagatgtctcctcccccacgaggctgccccagccctgctccatgcggcacctcgtgtcccactacctggacatcgccagcgtgcctcgccgctccttcttcgaactcctggcctgtctatccctccatgagctggagcgggagaagctgctggagttcagttctgcccaaggccaggaggagctctttgaatactgcaaccggccccgcaggaccatcctggaggtgctctgtgacttcccgcacacagctgccgccatccctcccgactacctgttggacctcatccccgttatccggccgagggccttctccatcgcctcctcgctgctgactcacccctcacggctgcagatcctcgtggctgtagtgcagttccagactcgcctcaaggagccccgccggggcctctgctcctcctggctggcatccctggaccctgggcaaggacctgtccgggtgcccctctgggtgcggcctgggagtctggccttcccagagacaccagacacacctgtgatcatggtggggcctggcactggggtagcccccttccgagcagccatccaggagcgtgtggcccagggccagactggaaacttcttgttttttggctgccgctggcgggaccaagacttctactgggaggctgagtggcaggagctggagaagcgggactgtctgaccctcatccctgccttctcccgggaacaggagcagaaagtatatgtgcagcaccggctccgggagctggggtcgcttgtgtgggaactgctggaccgccagggtgcatacttctacctggcaggcaacgccaagtccatgccagcggacgtctcggaagccctgatgtccatcttccaggaggagggtggactctgcagcccggacgcagccgcgtatctagccaggctccagcagacacggcgcttccagacagagacgtgggcctgaggcccgcggctgcccgtgccccctctgacagccatcctcctgggagcccaggaaggcatccacgagggagctcctggccagcagccgtcatcctctcggaccagccagctggtcctctgggaacagccagctcccgagcacagccgcactcctgttgaccctggatcccaccctttgagcctgaccccactgcagcctctgcccagccagccctgcgctcccccaccctgacagtgagctgtgtcctcgtccccccacccccttcccagtcaaggtggtggcctgggccgctccacctcaccggtgcagtgacccaggacggcatcagcagcccagtgagcaccaggggtggcatagggcacccatgaggctgcgctgcactcctctgccctggggccacctcggctgctgcagcctgcccagcagcacattccagtcactgcccccgcactcccacagggctcaggctgggctcagaggccactgagatgccagctccttgagagcagtgggggtgtcccaggccagagcagcctcttcctctcctggtcccagaaaaacccttgcagtaaatggtggcctctgggtggtta

SEQ ID NO: 1268 - DNA, 2135 bp, Homo sapiens
ttttattaatatgctgatctgttttatcttctcaggccataaagaatgctgatgggagaaccattttcctaattttcaaattgttgagctgtttgccataatggatgatcagcaagctttgaactcaatcatgcaagatttggctgtccttcataaggccagtcgaccagcattatccttgcaggaaaccagaaaagcaaaatcttcatcaccaaaaaaacagaatgatgtccgagtcaaatttgaacatagaggagaaaaaagaatccttcagttccccagaccagttaaactggaagatctgagatctaaagctaaaattgcctttggacagtctatggatctacattataccaataacgagttggtaattccattaactactcaagatgacttggacaaagctgtggaactgctggatcgtagtattcatatgaagagcctcaagatattacttgtaataaatggaagtacacaggctactaatttagaaccattgccatcactagaagatttggataatacagtatttggagcagagaggaaaaaacggctatctataataggtcctactagtagagatagaagttctcctcccccaggttacattccagatgaattacaccaggttgcccggaatgggtcattcactagtatcaacagtgaaggagagttcattccagagagcatggaccaaatgctggatccattatctttaagcagccctgaaaattctggctcaggaagttgtccatcacttgatagtcctttggatggagagagctatccaaaatcacgaatgcctagggctcagagctacccagataatcatcaggaattttcagactatgataaccctatctttgagaaatttggaaaaggaggaacatatccaagaaggtatcatgtttcatatcatcatcaagagtataatgatggtcgtaaaacttttccaagagctagaaggacccaggggaccagcttacggtctcctgtgagtttcagtcctactgatcattccttaagcactagtagtggaagcagtatctttaccccagagtatgatgatagtcgaataagaagaaggggaagtgacatagacaatcctactttgaccgtaatggacatcagcccacccagccgttcacctcgagctccgaccaactggagattgggcaaactgcttggccaaggagcctttggaagggtctacctctgttatgatgttgatacaggaagagaattggctgttaagcaagttcaatttgaccccgatagtcctgagaccagcaaggaagtaaatgcacttgagtgtgaaattcagttgctgaaaaacttgctacatgagcgaattgttcagtattatggctgtttgagggatccccaggaaaaaacactttccatatttatggaatatatgccagggggttcaattaaggaccaattaaaagcatatggcgctcttactgagaatgtgactaggaaatacacccgtcagattctggagggtgtccattatttgcacagtaatatgattgtccatagagatatcaaaggcgcaaatatcctgcgagattcaacaggcaacgtcaaactaggagattttggggccagcaaacggcttcagaccatctgtctctcagggacaggaatgaagtctgtcacgggcacaccatactggatgagccctgaagtcatcagtggagaaggctatggaagaaaagcagacatctggagtgttgcatgtactgtggtagaaatgctaactgaaaagccgccttgggctgaatttgaagcaatggctgccatctttaaaatcgccactcagccaacaaacccaaagctgccacctcatgtctcagactatactcgagatttcctcaaacggatttttgtagaggccaaactgagaccttcagctgatgaactcttaaggcacatgtttgtgcattatcactagcagccagtaacctctcctgtgcctctacctagctcccatctattcattcaccttctctctgactgcacttttcttttttataaaaaaagagagatgggggagaaaaaagacaagagggaaagtatttctcttgattcttggttaaatttgtttaataataataatatcctaaatt

SEQ ID NO: 1269 - DNA, 5479 bp, Homo sapiens
cttggtgaagtgagattcagactgagtggggtcacagcacagggcactgtcttgcctggctttatctgagccaatcacacctctcctggccactatctgtggtctagccccctttgtgcagaaagagaaagaagagccttgaggaccagcctagtcaggctgaagaaatgtcaacaattgggagttttgaaggattccaggctgtgtctctgaagcaagagggagatgaccaaccctctgagactgaccacctatcgatggaggaagaggacccgatgccaagacagatttcaaggcagtcaagtgtgaccgaatcaactctttaccccaatccttatcatcagccttatatctcacggaagtactttgctacacggccgggggccattgagactgccatggaagacttgaaaggtcacgtagctgagacttctggagagaccattcaaggcttctggctcttgacaaagatagaccactggaacaatgagaaggagagaattctactggtcacagacaagactctcttgatctgcaaatacgacttcatcatgctgagttgtgtgcagctgcagcggattcctctgagcgctgtctatcgcatctgcctgggcaagttcaccttccctgggatgtccctggacaagagacaaggagaaggccttaggatctactgggggagtccggaggagcagtctcttctgtcccgctggaacccatggtccactgaagttccttatgctactttcactgagcatcctatgaaatacaccagtgagaaattccttgaaatttgcaagttgtctgggttcatgtctaagcttgttccagctatccagaatgcccacaagaattcaactggatctggaagaggaaagaaactgatggtgttaactgaacccattttgattgagacctacacagggctgatgtcattcattggaaaccgcaacaaacttggctattcccttgcccgtgggagtattggtttttgagagtctttttggtaccataagcatatcatccacagatatgtcactttgaaaattccagtttgacccacgctatttttggactgaaacaattaattatttttaaatgacgctttatgatttagaaatttagtatttccgaaaatttaaaagcttgattggactgatagatacacactttagacctcatacaagaataatcaaattttcttaaaactagaaaataaatgctgctgagcctatcaaatactgttatcaaatgagtgcctgatcatcaactcaggaaagaagactctaagtcctgttgcttcagctctctaaatgtaggcttttttttttttttttttttaggtcttggtcttcagccctcttatcctgatttattctctcattggggtctcactgtctctagtattttagctaccacttgataaggatgacttccaaatttatattcccattcccaatatttattccaagactcagttttgcatttctgactgctaatcatctatatatcagtgtcccagtggcctcttaattgagcattatcaaaatcctgtggtatttatatggtcccagttatccatccctgaagtctgtcaattttgatttctctaaattccttgccatgacatcctatatatgatcacatctctatacggcttagcattgtattccgatgcccagatgtcaaacttgaagctcattctcttatcaaaattgttcatgtattcctcctttccattcttatagctgtattattagatcaggtttttaattctgctcaaccaattattaccacagcctgttaaatggaatccctactccaaggctgactgtttcaatctatcctacacttggtttctagctcatttacttataccatcttttgttcaaatatatattttttaataacagacctttttcttctaaagaaatcttttgtagaagcagcatatacgaagcagataaaagtaggttcaatgcggttggagtgaagatgagaatgccacaggcatctttctttctaggcctcagaggtgctgcatatggaatgtccatggatcgcagagggttttgaagaccatgttttcaaaaacactgtcttaacactctattgtcattgctcttttccctcttatttcctctttgtctcttcccgacttagatctaattttcaacaacccaggaaattatctcatatgtttgcatctctcaagtttcttttcttttttctttcagagtcttattttatctaaatttatgtagaaaaaaaagctttgaatgttgactacatagacattactacaataagctttttgcctttcccaagactcaaaattgacacatctttgttgatgtttaagttgaaattccagccaacttttttttgacttttatgtgaagtttaaagtcttttctttgaaaagcttgcttcctcaatttcaaagatttgtcctctgatatatttataaacatcaatttaatgcagacattcaaaccctaaaccttgaataactcttattttattttgtctttgtttacttccattaatttttttttctttccctctcttccgcctttacagcacccactttttcttccccccatgatggcaaatattgttatagtccccaaggcagggaacttctattcagactgtaaaaggaaatgttgaaatccatagctgtcctgtcaacagtagtggaatgaaaagtcgttggattgttttggcactggttctgaagcaggcataattggcaaattattataatactgctgcccgaaaatccccatttgcctcaagatagtggcatttattggcagaagcctctgaaatgtccagcacattcttttgagttaccatttaaggatcagcctgacaatcgacttctctctgcacatttgccccctttgtaacctaagccagactgttcccaaatgaccttctaaaggacacagtgcaccatcatcaatggaaacagttcagaaaggatgacaggagggagatgtttcttagttctgagagccagtctgtaacaatgggataagcatttaatggaatcaaagctgttttgcataaagagtgaactcagagacgacaagagggtctttatgaattcccttcacattttgtaaaaactgtcatatataggctatccccttaattgataaatgggatctagaaagcggtattatgaccagagggtgagaagatttaggaatttggatagcagttcaagataagaaagaacttcttatagttataaattttcaatgatggaatgggttgcttctttaaacagtgagcccaccatcacttggtatgttcaaggaaagactagataaagtcgatattgtgagaggaattgctgtatgataccgtttggagaaatgattgacataatcttttaaggccggtgaccctatcattttccaaataattgttgctagtacttagttaattagacccatttttttcttaggaaagagttggatcaatcatgggagaccctgaaaaatttccttacctttcctaaggtttaatttcctcttctgcgaaatggagacaattatattacttttgcttatttcataaagatcttgtgaggattcaatgaaatgaggttaaattcttttattaaacagaaagttttgagtatttgcctagagagtgatgtgacttttgcagcagaaggtgggaaaacatccaagggaactacatttcctccagaaattgtttcttcattaccatcgacctactgattatggttttctcattttacacttggtgttcttacttgggatctttgtccttaagctcaacagggagccacaacccaggggacctatgtgtacacttggagtttttatcagactatcatttgaacttaccactacagtttagcaaatggcatgatgagtttgattgataataggagtagacgcaagatacattaagtagagtacaaagcatttcataaccaaaatgtcatggttggaggtcttcattattcggtctttatctcattcaggaatttccacttgaaaaatctctgataagctttatttcagaaactgcttgaacagctccactgacaaatgcctcactatcttctgatacatcgtaggcagttctgagggtgagaaagttcaaagcagatagatgttttaacacaacaggaggacttttaaacaatcaccaggactcactcctcggtggtcaattgggcctgtttggaggcctgacctttggtcatcttaaggtcatctaaggcagaaaagagaagctcacttataagttggcacttctgaatcatttgccttgaggtccattttttattcagcctttgtttaaaccttcttaggaagccagtttgtagagttctggggataagaaggcagaaaaaccatgtcaattcagtgcttttatttcacagaaaatgaagcaaaggcctagaaactagaaagacatttctcaaaaagaagatggtgaacttttggaaatactgagattagactacattttccaatttctatccctagcccactgctctttccaatataatatctgtattccatgggaaagacatgccatctgaattgatgtatcgtagttgttgagataattttgaaatgagaaaacaatagggcacagtcgtttgggaagaatttccagaaattgccatcattttcttaaaggctaaggacacttatagagctctccgatttcctatctgataaaaaaagcccaaacaaagctgcggaagctggcagagccagcagatattttgtaaggcagcttcacctctgctggcattttgtggggcaggagagggggagggcaaaggtattaaatttaggcttaaaagctcctcagaaattctttacacacaagagaccaagttggagaaaagaagatgacttgtgccaaggggaagaaagagagagactaatgcctgtggttttcaaaggttaacaacaacataaaaaagccaaggtatttgcacagggatgaatgctcattggctcttggccaacaattatacaagggcttgtgcccacatcctgtagctgtggtttagggacgctgctcatgagtgacttcttatgcttagtggcaggaaactttagtcactgatgtgtaaactcacctttggtctgcacctcccacaacgtgctccgaaagcagttaggggactaggcctcttgatttccttgtagataccagttccccagaagctaaggaaaaactctgaggccttggagttactgagagtggaccaatacttgtcttattctacctgattttggcaactgcttagggttcttctgtatccacaaaaaggaattatgatatcctctgctaaaccctctctttagcctcaaagcccaagaccaaaaaaaatgagccatatttcattgcaggcctgctgccaatgtgaaatataaggaataaagtcatgagactgcttctcaaccta

SEQ ID NO: 1270 - DNA, 2606 bp, Homo sapiens
gatggcagcggcagctggggctgcagcggcgccgggctctagagagccgcaggatcggccagagtgcggagctggacacccgggtcccagatactacagacacccggagaggtggctccttcgccctgaagccttcctcggccccctacgcactcgggccccttccgcagaggattcgcagcgtgagcgccccgcagcccgctcaggaccagctatgagcagacgtgtggttcggcaaagcaagttccgccatgtgtttgggcaggcagcaaaggccgaccaggcctacgaggacatccgtgtgtccaaggtcacatgggacagctccttctgtgccgtcaaccccaaattcctggccattattgtggaggctggaggcgggggtgccttcatcgtcctgcctctggccaagacagggcgagtggataagaactacccactggtcactgggcacactgcccctgtgctggatattgactggtgtccacacaatgacaacgttatcgccagtgcctcagacgacaccaccatcatggtgtggcagattccagactatacccccatgcgcaacattacggaacctatcatcacacttgagggccactccaagcgtgtgggcatcctctcctggcaccctactgccaggaatgtcctgctcagtgcaggtggtgacaatgtgatcatcatctggaatgtgggcaccggggaggtgctgctgagcctggatgatatgcacccagacgtcatccacagtgtgtgctggaacagcaacggtagcctgctagccaccacctgcaaggacaagaccttgcgcatcattgaccccagaaaaggccaagtggtggcggagaggtttgcggcccacgaggggatgaggcccatgcgggccgtcttcacgcgccagggccatatcttcaccacgggcttcacccgcatgagccagcgagagctgggcctgtgggacccgaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgatctgtacccggatacgccaggcccggagccggccctagaagcggacgaatggctatccggccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaagcctccggt

SEQ ID NO: 1271 - DNA, 4384 bp, Homo sapiens
ggcggatctgtagtagttaccgcggcggcgggagagcaagcgagccctggggggcaaagagacgggagagtgggtgtatgcgcgggtgaagtgagaggtaacggggctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggatttttttttaaaacattacagatatagttggagtttcatatgtaccccttcacattcccattcccattctaccccctcttcctccatctctcaagataatatagttggatcaaacaaaaacaacacaatttgtcccgataattatcaaacagcacagctacttgccttaattttagagttactcacattttgtgtggaacatcacacatatcacataaaaaactatattatgaacaaggacttgctaagaagagtcttggtcttgatgaattcaaagcacacttttctggccttgtgtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtgtaccatctatattgcgtagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagacagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccaaaatgattttctctagaaatttgaaagtagatcgaacagaatgttgtcaaccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatctttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattcc

SEQ ID NO: 1272 - DNA, 913 bp, Homo sapiens
gcggggcggcggggcggccggcggcggccatgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccataactaaaaatcacaaagactatcctttccacatagaatactgaggacgcttccccttccttgtttctgctcagcccagatgcacagacactattggcaatgttgaccctcctctgtcatcacagcgccagggcagctgtgcctgggacaggagccacacagtcagagggggatgtaagagccaccttctctgacaaatctggagaattgagtgtgttctaagtgaaggcaatggggtttctccaagacagcctgtgtg

SEQ ID NO: 1273 - DNA, 3998 bp, Homo sapiens
aggctctttcttctggggccgggaaaaccgaggaatacacatgcgcagttggacccctcaggcccttcgtgtcccttcccacccatctccccgccccggccctctgggcggggctgggccgacagtccagctgcagctcgctggagattcagtgacttccttgttgtgagccccggcccggcagtgtcccgactcgtagccccgctgttcttaatccgggccgctagcctgagtctaggtcgcagccgcagccccaccccgtcggtcaccttttcagcgcaggtcctttccccgcacgccctgcgctccctaacatgcccaaccccagcagcacctcctctccctaccccctccctgaggaaattaggaacctgttggcagatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatggagcccagtttcctccaattgcagcacaagaccttccttttgttctaaaggctggctaccttgaaaaacgcagaaaagatcacagctttctgggatttgaatggcagaaacggtggtgtgctctcagtaaaacggtattctattattatggaagtgataaagacaaacaacagaaaggtgaatttgcaatagatggctacagtgtcagaatgaataacactctaagaaaggatggaaagaaagattgctgttttgaaatctctgctcctgataaacgtatatatcagtttacagcagcttctcccaaagatgctgaagaatgggtacagcagctgaaatttgtattgcaagatatggaatctgatattattcctgaggattatgatgagagaggagaattatatgatgatgttgatcatcctctaccaataagcaatccactaacaagcagtcaaccaatagatgatgaaatttatgaagaacttccagaagaagaagaggacagtgctccagtgaaagtggaagaacaaaggaagatgagtcaggatagtgtccatcacacctcaggggataagagcactgattatgctaatttttaccagggattgtgggattgtactggagctttttctgatgagttgtcatttaagcgtggtgatgtgatttacattcttagcaaggaatacaatagatatggctggtgggtaggagaaatgaagggagccattggcttggtgcctaaagcctacataatggagatgtatgatatttgagagtcctggaaaaggaaaattcttctgcttgtctgcaaatgctttggatttagaagcgtcatgaaagcacgagtgacagctcctaacctctccttgttttattaaacattacttatctttgactgttattttatgcagtcgctcattaaaatattcctctgatgtgaaattaaatgaaggatattaatgtaaattagatgcaaccagttaagttatacctgttgctattttgcaaagaaataattatagtttttatttacccatttgatttgtgtgaagaattcatcactattttatacgtaacatatagtctactatagcatagtatgctactattgctacttctggtgtgatttgtaatgtttcttaatcattggacatcaattatttttagagagtaatgtataatttcatagcattttaaatttagtgtatcatgcgagttttttttggtagatgctgaagaatgtggttgctaaacaaagaatgctaaagaatgttcaaactttatagataactttattgttattatttattttcacacatttaattcctattaagtacagccgcaagaaagaaaaaatgatgaagttgcaaatggcagtgtgctgtcacctgcaacagaagtgcgtaccagaagtatgactcatgcaaagcattttaccgtacaaatatcctggtgcgatgatgggcctggcaacattttctactgtacttttgtttaaatttaatgaaacaaaaaattcctaagaaataccaccctaccactaacaaaatggtataaagaatctcccagccaggccaacatggtgaaaccctgtctctactaaaaattagccaagtgtggtaatgttcacctgcagtcccagctacttgggaggccaaggcacgagaattgcttgaacaaggtaggcagaggttgcagtgagccaagatcgcgccactgcactccagcctgggcgacagagtgagactccatctcagaaaaaaaaaaaaaaaaaaacagaatctcagtgtattctcaaagtaaaaaggcataaccaagcactctcttatcttgccttattgctatactatttacatcccactgcagaacagcagatttgaggcttttctatatacttctcagagcactgaaaagaaaggaagggtttgcagaggagagtgtagaaatcccagtggtagcatgtaccaacaggtgagtagaaaggtagtgttagcctgacatttgagttatactctgtgctgcctgagcaagatttgtagaatcatataattaccttttcatgtatatttgaaatcagaggtgtttaaaatacctatgagataccaatgtagccttaacatatgtcaaaatgcattgctggttagataattatttggactacacataaactcctaatattgaatcattacctatcaggtattatctttatggaacttttcaatatctttgctttataaagattctaaacatgtatctgagctggtaatattttaaaatctccattatttgtgtaaaactgtttataagcagtgtttgagagggtctgctttaccattaccccctcaatatcatgatcatccaatctcaaatgtgaaaaaaaaaaagaaatttgattttagggattgtgagtaaacaagtttatatagagagacattgtgaagttaaagttttcagaagttacatttgtgcagttcttaccttttcctcatatagtgccattgaaatagactgaaattatcttggcaaaagttagacaaccaaagacgactttagtggactggttttcaaaacttgagcagctgaaaagcaaaagccgttgtttcccatgacaatgtagcctttgtggatttgggtttgtgctttgggttgaaaagaagtttttagtcctaggccagtagatggcagcagcttttcattgcagacaaaacctcttgaaacccttcccccatggcacaaactcgcccatgatggaaagcatctagatttctgcctccttttacagttaatccaggagagggagtcctttgccaactgatgaccaacagttccaagccagatagtctcgtgaacagtgacaatacagaaataaggtgttatttctgttcagatctccaccggcctttgttcttttaaaacttgaatataggtgggagacataagaaaggaaagaaaagacttaaaactggagtgacaggacaaataatcattactttcaattcatgactgctttatattcatttgatgaaatcatttgtatacaaaccagggagagttttctttacacccttgacaatatatcacatactcttcaagatcataataatatcattaatataaatttaaacaacatggcttgttagaaaatatgctaattgctatggtctcattatgtttgcttagcttttatttgtttttctgtgaacagttagagagctaatttttttcaaaggtgattgtaagtcatattttatatagcattttgcttgattatttgctctgtactgaatttgtactctattgccattagatcttacaataatgttccactctgcaaatttttaaggttcaaataaagtttaattgtttgcaaactgtta

SEQ ID NO: 1274 - DNA, 1475 bp, Homo sapiens
attggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaaaccgctc

SEQ ID NO: 1275 - DNA, 4669 bp, Homo sapiens
tgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgagcgtcagcattaaatattctcccaaggagtgccatgatattgaagtcactttattaataacagctgtatctgcaaaacagtcaagagactcggacgttgaaagccagagatgacactgagcatgcttttattgcggcctaccatctttaagtgggacatattgattgatgagtgattgcctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcaccatggctttgaacgttgccccagtcagagatacaaaatggctgacattagaagtctgcagacagtttcaaagaggaacatgctcacgctctgatgaagaatgcaaatttgctcatccccccaaaagttgtcaggttgaaaatggaagagtaattgcctgctttgattccctaaagggccgttgttcgagagagaactgcaagtatcttcaccctccgacacacttaaaaactcaactagaaattaatggaaggaacaatttgattcagcaaaaaactgcagcagcaatgcttgcccagcagatgcaatttatgtttccaggaacaccacttcatccagtgcccactttccctgtaggtcccgcgatagggacaaatacggctattagctttgctccttacctagcacctgtaacccctggagttgggttggtcccaacggaaattctgcccaccacgcctgttattgttcccggaagtccaccggtcactgtcccgggctcaactgcaactcagaaacttctcaggactgacaaactggaggtatgcagggagttccagcgaggaaactgtgcccggggagagaccgactgccgctttgcacaccccgcagacagcaccatgatcgacacaagtgacaacaccgtaaccgtttgtatggattacataaaggggcgttgcatgagggagaaatgcaaatattttcaccctcctgcacacttgcaggccaaaatcaaagctgcgcagcaccaagccaaccaagctgcggtggccgcccaggcagccgcggccgcggccacagtcatggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacagggtcagttttgtgcatgacacccgctaccagtattgtacccatgatgcacagcgctacgtccgccactgtctctgcagcaacaactcctgcaacaagtgtccccttcgcagcaacagccacagccaatcagataattctgaaataatcagcagaaacggaatggaatgccaagaatctgcattgagaataactaaacattgttactgtacatactatcctgtttcctcctcaatagaattgccacaaactgcatgctaaataaagatgtagttcttctggacagaccacaactctaagaagctagtgctgctatctcatatatgagtattaaatatggtatgcttagtatattccaacctaagatagttaactacctgagaccagctgtgatgtttaaagacataaaggataaagtttacttttaaagggtttctaaacatagtttctgtcctaggaatattgtcttatctccataactatagctgatgcagaaagtccagccagtttactcatttcgattcagaatatttcaaatttagcaataaacaattagcattagttaaaaaagaaacatattccaagggcaggttcgattctagctctaattactgtcatgtcatttacccactggatcaaagggtatgtttcacttcttgacaatataaatgctgcagcaaagatgagaggtgaagtaaaaccgatacctgtcctgcaggtctaaaatttgaatggaaattcaagcacaagtactggggacacatcaaagtgtggtgtttggtttgcctggagatgccacgttgaatcatgtgattctagattaacattaaatagattgaaaaagaaactttgcacggtatgagcttcataccccaccaaacaaagtcttgaaggtattattttacaagtatatttttaaagttgttttataagagagactttgtagaagtgcctagattttgccagacttcatccagcttgacaagattgagaggcccatgccaacagtctaatctaagagattagtctttcaaactcaccatccagttgcctgttacagaataactcttcttaactaaaaacctagtcaaacaaggaagctgtaggtgaggagatctgtataatattctaatttaagtaagtttgagtttagtcactgcaaatttgactgtgactttaatctaaattactatgtaaacaaaaagtagatagtttcactttttaaaaaatccattactgttttgcatttcaaaagttggattaaagggttgtaactgactacagcatggaaaaaaatagttcttttaattctttcaccttaaagcatattttatgtctcaaaagtataaaaaactttaatacaagtacatacatattatatatacacatacatatatatactatatatggatgaaacatattttaatgttgtttacttttttaaatacttggttgatcttcaaggtaatagcgatacaattaaattttgttcagaaagtttgttttaaagtttattttaagcactatcgtaccaaatatttcatatttcacattttatatgttgcacatagcctatacagtacctacatagtttttaaattattgtttaaaaaacaaaacagctgttataaatgaatattatgtgtaattgtttcaaacatccattttctttgtgaacatattagtgattgaagtattttgacttttgagattgaatgtaaaatattttaaatttgggatcatcgcctgttctgaaaactagatgcaccaaccgtatcattatttgtttgaggaaaaaaagaaatctgcattttaattcatgttggtcaaagtcgaattactatctatttatcttatatcgtagatctgataaccctatctaaaagaaagtcacacgctaaatgtattcttacatagtgcttgtatcgttgcatttgttttaatttgtggaaaagtattgtatctaacttgtattactttggtagtttcatctttatgtattattgatatttgtaattttctcaactataacaatgtagttacgctacaacttgcctaaaacattcaaacttgttttcttttttctgtttttttctttgttaattcatttaaactcattgaaaacatagtatacattactaaaaggtaaattatgggaatcactgaaatatttttgtagattaattgttgtaacattgtctttcttttttttcttttgtttcatgattttgatttttaaaattattagcacacaactattttcagccctttaataatggagcatcaaaaacatcacctgtaaccccaagcaaatatagaagactgtattttttactatgatatccattttccagaattgtgattacaatatgcaaagagtcataaatatgccatttacaataaggaggaggcaaggcaaatgcatagatgtacaaatatatgtacaacagattttgctttttatttatttataatgtaattttatagaataattctgggatttgagaggatctaaaactatttttctgtataaatattatttgccaaaagtttgtttatattcagaagtctgactatgatgaataaatcttaaatgctttgtttaattaaaaaacaaaaatcaccaatatccaagacatgaagatatcagttcaacaaatactgtagttaagagactaactctccacttgtatgggaactacatttcactcttggttttcaggatataacagcacttcaccgaaatattctttcagccataccactggtaacatttctactaaatctttctgtaacacttaaagaattccctcattcattaccttacagtgtaaacaggagtctaatttgtatcaatactatgttttggttgtaatattcagttcactcacccaatgtacaaccaatgaaataaaagaagcatttaaaagga

SEQ ID NO: 1276 - DNA, 5062 bp, Homo sapiens
gataaggtggcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggcccttccttggaggagaagttcctagtatcttgtgatataagtacatctgggcaggaacaaattaaattaaatacttctgaagttggccacaaagccctaggcccaggttccagtaagaagtatcccagtttaatggccagtaacggggttgctgtagatggatgtgtaagtggtaccaccactgcagaggcagaaaatacttcagatcaaaacctgtcaattgaagagagtggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagatatagaggacttaaaatatgctgcttttggaagctacagtagcaattttgcagtgagcacacttacaagctatgactggtcagacagggatgatgcaactcagggcagaaaactctctccatttgtcctctcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccgggcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaactgatgttctgctttttatggagaagattctgcccatctcccctggacagtagcaggcaggtgagggcagattttacccacttggttgtcacaactgaaccagttctctactccttcccttcacttctgtccactctcaagactttttcccaaaacatgcctgggcactctgcagccgtgaagaatgctcattttgacagaggcccaaatcctgtgtattaggataatatccttccccccgggagccttcgctgcaaacctgttctgccgcatgcaaagactgtgaccatggagttttctcagacaagatttggaaaggcagtggaatgaaatctctttgcagtggcctctctccaaatttccaaagatgactgcatagggaccaacactgcctgactttgcagtatctgtgagaaaaacctgaaaattaattcagggtgaaaatgtggagctctcggcctagtgtaaagtatcaagatgtatatttatgggatagatacatgacttagaagaagtagaagaaaattgtccagaaacagtactgaattttagatagaaaaggctcatgcttcctggagtagggaattgtctttgccatttaatgtgaatgcataaaattaggggaaaaacc

SEQ ID NO: 1277 - DNA, 2129 bp, Homo sapiens
ggagttgcagtttgagagcagttccgggcagggaggcgcctttgctgccctcacagacttggcccctagcagtgcagaactacaagtcccagggatcctagcgaccgtccgtccgtagtcaagttgccggtggaattggcccaggatgacagctggagaatggagtcagttttatccaagtatgaagatcagattactattttcactgactacctagaagaatatccagatacagatgagctggtatggatcttagggaagcagcatctccttaaaacagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtatacccta

SEQ ID NO: 1278 - DNA, 3544 bp, Homo sapiens
attggtgagtggggcagggcaggagggaactgaagagtgagaaagcattatttcagcaaaaggtctttcctcccttgctctctcctccaaccactggctcagcctctccgcccgctgcctgtgaatgatgcaatggaaggtgtgctggggtcgccctgtgtcccgtgcataggagcatctcagcctccaggtcctctcctttggggctcacggcacccccatgctacgaaccgcaggcagggacggcctctgtcgcctgtccacctacttggaagaactcgaggctgtggaactgaagaagttcaagttatacctggggaccgcgacagagctgggagaaggcaagatcccctggggaagcatggagaaggccggtcccctggaaatggcccagctgctcatcacccacttcgggccagaggaggcctggaggttggctctcagcacctttgagcggataaacaggaaggacctgtgggagagaggacagagagaggacctggtgagggataccccacctggtggcccgtcctcacttgggaaccagtcaacatgccttctggaagtctctcttgtcactccaagaaaagatccccaggaaacctacagggactatgtccgcaggaaattccggctcatggaagaccgcaatgcgcgcctaggggaatgtgtcaacctcagccaccggtacacccggctcctgctggtgaaggagcactcaaaccccatgcaggtccagcagcagcttctggacacaggccggggacacgcgaggaccgtgggacaccaggctagccccatcaagatagagaccctctttgagccagacgaggagcgccccgagccaccgcgcaccgtggtcatgcaaggcgcggcagggataggcaagtccatgctggcacacaaggtgatgctggactgggcggacgggaagctcttccaaggcagatttgattatctcttctacatcaactgcagggagatgaaccagagtgccacggaatgcagcatgcaagacctcatcttcagctgctggcctgagcccagcgcgcctctccaggagctcatccgagttcccgagcgcctccttttcatcatcgacggcttcgatgagctcaagccttctttccacgatcctcagggaccctggtgcctctgctgggaggagaaacggcccacggagctgcttcttaacagcttaattcggaagaagctgctccctgagctatctttgctcatcaccacacggcccacggctttggagaagctccaccgtctgctggagcaccccaggcatgtggagatcctgggcttctctgaggcagaaaggaaggaatacttctacaagtatttccacaatgcagagcaggcgggccaagtcttcaattacgtgagggacaacgagcctctcttcaccatgtgcttcgtccccctggtgtgctgggtggtgtgtacctgcctccagcagcagctggagggtggggggctgttgagacagacgtccaggaccaccactgcagtgtacatgctctacctgctgagtctgatgcaacccaagccgggggccccgcgcctccagcccccacccaaccagagagggttgtgctccttggcggcagatgggctctggaatcagaaaatcctatttgaggagcaggacctccggaagcacggcctagacggggaagacgtctctgccttcctcaacatgaacatcttccagaaggacatcaactgtgagaggtactacagcttcatccacttgagtttccaggaattctttgcagctatgtactatatcctggacgagggggagggcggggcaggcccagaccaggacgtgaccaggctgttgaccgagtacgcgttttctgaaaggagcttcctggcactcaccagccgcttcctgtttggactcctgaacgaggagaccaggagccacctggagaagagtctctgctggaaggtctcgccgcacatcaagatggacctgttgcagtggatccaaagcaaagctcagagcgacggctccaccctgcagcagggctccttggagttcttcagctgcttgtacgagatccaggaggaggagtttatccagcaggccctgagccacttccaggtgatcgtggtcagcaacattgcctccaagatggagcacatggtctcctcgttctgtctgaagcgctgcaggagcgcccaggtgctgcacttgtatggcgccacctacagcgcggacggggaagaccgcgcgaggtgctccgcaggagcgcacacgctgttggtgcagctcagaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgaggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccagtgcaggctgcagatgattcagttgaggaagtgtcagctggagtccggggcttgtcaggagatggcttctgtgctcggcaccaacccacatctggttgagttggacctgacaggaaatgcactggaggatttgggcctgaggttactatgccagggactgaggcacccagtctgcagactacggactttgtggctgaagatctgccgcctcactgctgctgcctgtgacgagctggcctcaactctcagtgtgaaccagagcctgagagagctggacctgagcctgaatgagctgggggacctcggggtgctgctgctgtgtgagggcctcaggcatcccacgtgcaagctccagaccctgcggttgggcatctgccggctgggctctgccgcctgtgagggtctttctgtggtgctccaggccaaccacaacctccgggagctggacttgagtttcaacgacctgggagactggggcctgtggttgctggctgaggggctgcaacatcccgcctgcagactccagaaactgtggttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccagg

SEQ ID NO: 1279 - DNA, 1055 bp, Homo sapiens
atggtcagctcctgttgtggttccgtctgctctgaccagggctgtggcctggagacctgctgccgccccagctgctgtcagaccacctgctgcaggaccacctgctgccgccccagctgctgtgtgtccagctgctgcagaccccagtgctgccagtctgtgtgctgccagcccacctgctgccgtcccagctgctgtcccagctgctgtcagaccacctgctgcaggaccacctgctgccgccctagctgctgtgtatccagctgctgcagaccccagtgctgccagtctgtgtgctgccagcccacttgctgccgtcccagctgcagcatctccagctgctgtcgccccagctgctgtgtgtccaggtgctgcaggtcccagtgctgccagtctgtgtgctgccagccaacctgctgccgtcccagctgctgcatctccagctgctgccgcccctcttgctgtgaatccagctgctgccgcccgtgctgctgccgcccctgctgctgcctgcgtccagtctgtggccgagtctcctgccacaccacttgctatcgcccaacctgtgtcatttccacctgcccccgtcccttgtgctgtgcctcctcttgctgctgagctccttgcctgaaactatctcctccccttcagctcactcctcacagaagcagaccttgtgcatctcataaacaactcagaagaggccattcccaccaactgtgtttccatatcctggacatatatctaggatatatgtcctggctatacatctagaatatatgttccccatgttgacccaagtgtgaaattagatattatttacagaaagaaattaatagaatttaccaaattttataccttatatttgtatttatggataccaagttcttctgtcccaaacatggaaattcttgcagggtaactcggggcaaggttgtctcactctcagatttgaaagtctgattgtttcaccctgtatttccttttacagcaatgtttctgtatcttatttttgctgcttctgaataaaactccacttttgtcgcatagaaata

SEQ ID NO: 1280 - DNA, 982 bp, Homo sapiens
cgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgagcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcccctcagcttctctctggttttctca

SEQ ID NO: 1281 - DNA, 8131 bp, Homo sapiens
gataaggtggcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggcccttccttggaggagaagttcctagtatcttgtgatataagtacatctgggcaggaacaaattaaattaaatacttctgaagttggccacaaagccctaggcccaggttccagtaagaagtatcccagtttaatggccagtaacggggttgctgtagatggatgtgtaagtggtaccaccactgcagaggcagaaaatacttcagatcaaaacctgtcaattgaagagagtggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagatatagaggacttaaaatatgctgcttttggaagctacagtagcaattttgcagtgagcacacttacaagctatgactggtcagacagggatgatgcaactcagggcagaaaactctctccatttgtcctctcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccggaaagaagagaagcctgcagaagaacatcctaaaaaagcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaactgatgttctgctttttatggagaagattctgcccatctcccctggacagtagcaggcaggtgagggcagattttacccacttggttgtcacaactgaaccagttctctactccttcccttcacttctgtccactctcaagactttttcccaaaacatgcctgggcactctgcagccgtgaagaatgctcattttgacagaggcccaaatcctgtgtattaggataatatccttccccccgggagccttcgctgcaaacctgttctgccgcatgcaaagactgtgaccatggagttttctcagacaagatttggaaaggcagtggaatgaaatctctttgcagtggcctctctccaaatttccaaagatgactgcatagggaccaacactgcctgactttgcagtatctgtgagaaaaacctgaaaattaattcagggtgaaaatgtggagctctcggcctagtgtaaagtatcaagatgtatatttatgggatagatacatgacttagaagaagtagaagaaaattgtccagaaacagtactgaattttagatagaaaaggctcatgcttcctggagtagggaattgtctttgccatttaatgtgaatgcataaaattaggggaaaaacccaagtggctaagagctgtgttattcctgggaagaactaccaatctagggcacacgtctctctgaattgttgattatgcgctttatgaagagatttttcaatctcgtgtgctttactttgtgtggtttagaccctctgacctagacttttatttttaaactgaaaaagttggtcttgtctatataattgctgcttttacataatttattttcccctctcaggacaaattctgtcttgctccatcttacagcttttccatgttctccaagaaaggtgtggaacattttcattaaacagctgttgctgaggcttctgcttgaccttctgcgtgcccgaatgcacagagaggcaccgaggagagaaaggcttttctcactcgctcccgatgataccgtctctggccattcctgactgaggcagctcactctgaatgggcacctttggagcttttgcccaccacaaggctagtggggtgtttctaacaacacaagtgggacagcttttggcaggcttttcctgaggcctcggcgcttccatcctggacagcaccacttccacatggagctggaatgcaagcaggctgctaattggccttaaaaattctttgtttttttttgagatggagtttcactcttgttgcccaggcttgagtgcaatggcacaatctcagctcagtgcaacctccgcctcccgggttcaagcgattctcctgcctcagcctcgtgagtagctgggattacaggcgtgcaccaccacgcccagctaattttgtatttttagtagaggcaaggtttctccatgttggccaggcttgaactccggacctcaggcgatccgcccgcctcagcctcccaaagtaccgggattacaggcgtgagccactgcgcctggcctaaatttcataacagaaccatgacagcagaatctacctttgcaataagaatgtttcccaggagttagagaccagccctgggcatgatggtaaagaccccagctaattatacaaaaaataattagccgggtaggtggagtgcatctgtggacattcgtggtcccagctactaggtaagctgaggcgggagatcacaagtccaggagtttgaggctgcacgtgacagcgtaggtgatgacagagcgagacactgtctcttaaaaaaaaaaaaaaaaaagtttcccagtttgaatttgtattgctgaagcatttttttgaaatgctatatagatgcctgtcatgtcacagtggcccagtatcaacattttaaaaagctcacttggtagctgggctggtttctattcctgagaaattccagaatgcctcagataaaattccttagtataatccccattttccttaccaaggatggtaggcttagtcactccttgggaggtgccacaggaaaattcagcagatgtcaacagaaaaaaagcctttgctatgaaaagtattcactacctttcatatctcttgaatacttgaaatgtttaattagatgccaccaatagggatccaaggagtgtgggacacggttgcgctgcttttctttataaacgtttattaaaatggctcaacgctgcattcagcttcacctcagctcttcttgtcagccaggagccccgtgtccttggaaactgtagccaaggttacttatttccatactgtgcattgtgtcagcccgcttcaccccactgcttgaatggccattaataagcacttttctttttttggtgggatgttttgcctttaaaatttttatggcttagtgtgtaatttaatttttgtctggacatgcttgagatagaagaggtactggatatatgaggatattttccatgctttatttttcctgtggctactagttagcattccataggggttgtgaatttttaattatttgaatattttgtgtacatatacatatttgaagggttttgggggggtcttatttgtttaaaggtgtcttctgtttgcctatttcaagtgtacttcagctttgcaaagattatagggctgtatgttacagaaataggaaatgctggccctgtactggggaccactacaaaaattccctttagccgggcgtggtggctcacgcctgtaatccccagcactttgggaggccgagccgggtggatcacccgaggtcaggagttcaagaccagcctggccaacatggcgagaccctgtctctactaaaaatacaaaaattagctgggcatggtggcaggtgcctgtaatccgagctactcgggaggctgaggcaggagaattgcttgaaccagagaggcggaggttgcagtgagccgagatcgcgccactgcactccagcctgggcaacaagagcgaaactctgtctcaaaaataaaaaattccctttaacaccttcaaggtcaaatgcctgcctttgtgaacagttaataaactgacattttcagacatttgccattcagaagggagcattgtagcctgctgtagaccattccagcaaatgtcagaatgcagggcaagatgtgtgtcgactatgttttttatgtttaagttacttacttatttcttcaggtaagtgtgtaccaaataacaatactgaaaagccctccccttgccaggccgaggaaataaagcttaagtgaaacagctcttgggggaaaaatgccactttacaaatacttttctaacaaaatagcattataatgaagtttttacttaattccattatttatatgttgacgtgaatgtaagtggttaaaaagtattcatgtgggacatctcattactttgtagctgtggctttattaaccagtgaatgctgtggcccttagcgaaatgcgttgtcttctgcgtgatgtggaattcgcgcctgtattttaaaagatggtgtggtttctcccttgtttgtattttaataaacaactgctctaattgatgtgtttagacattataaagcttcacctttaaaatattttcagggtctgttctgaaatcaccccttgttaaacttctctaaccaaaatacaagtgtagaagaatgtcaggcta

SEQ ID NO: 1282 - DNA, 1398 bp, Homo sapiens
taatagttgctgttgctgcacttccgcttctctcccagcgagagagagacacgagtggccaggcccagccgcagccgcagcagcagccgccgcggcggcacggaggagccagacacaaagagaggggctgtttgcggggtggggtggggggttcgctatgtcggatgacgattcgagggccagcaccagctcctcctcatcttcgtcttccaaccagcaaaccgagaaagaaacaaacacccccaagaagaaggagagtaaagtcagcatgagcaaaaactccaaactcctctccaccagcgccaagagtgctggtcccaaaggcgataacatctatgaatggagatcaaccattctagggcctccaggatccgtgtatgagggtggtgtattctttctcgatatcacttttacaccagaatatcccttcaagcctccaaaggttacatttcggacaagaatctatcattgtaatattaacagtcaaggtgttatttgcttggacatattgaaagataattggagtccagcactaaccatttctaaagtcctcctttctatctgctcacttcttacagactgtaatcctgccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaaca

SEQ ID NO: 1283 - DNA, 9573 bp, Homo sapiens
aagcaatcgaaagaagatggccgctcccacgattgtgggggaggtctccactggggaggggcagaggaaattcggtcgaaaaagagataaagctgaaggaaataaaattggcacggagtctgggaaagtagtttccctaaaggagtcttagaaatagggttggtctggaacctaaggggcggagccgacgcgtagagccgctttgcgcgtgcgcatcacctaggcggttagatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcagaaaagttttcttcaaaaatggatggggtgtcttcagaggctaatgaagaaaatgacaatatagagagacctgttagaagacggcattcttcaatattgaaacccccaaggagtcctcttcaggacctcagaggtgggaatgaaagagttcaggaatccaatgctttgagaaataagaaaaactctcgtcgagtcagctttgcagatactataaaggtattccagacggagtctcatatgaaaatagtgagaaagtcagaaatggaaggctgcagtgcaatggtgccatctcagctgcaacttctgcctcctgggtttaagcgattctcctgcctcagcctcccagaaacagaaacaggagaaaatcttcttttgatacagaataagaaattagaagataattactgtgaaattactgggatgaacacattgctttctgctcccattcatacccagatgcaacagaaggagttttcaattatagaacatacccgtgaaaggaaacatgcaaatgaccagacagtcattttttcagatgaaaaccagatggacctgacatcaagtcacactgtaatgattaccaaaggccttttagataatcccataagtgaaaagtccaccaagatagataccacatcatttctagctaatttaaagcttcacaccgaggactcaagaatgaaaaaagaagtaaatttttccgtggatcaaaacacttcttcagaaaataaaatagatttcaatgacttcataaaaagattgaaaacaggaaaatgtagtgcttttcctgatgtgcctgataaagaaaattttgagatacctatttattccaaggaaccgaacagtgcctcttctacacatcaaatgcatgtatctcttaaggaagatgaaaataacagtaatattactaggctctttagagaaaaagatgatgggatgaatttcacccagtgtcatacagccaatattcagacattgattcccacatccagtgagaccaactcacgggaatctaaaggtaatgatattacaatttatggcaatgactttatggacttgacatttaaccacactttgcagatcttacctgcaacaggtaatttttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattatgctaaaatgtattgcaatccagatgctatgtcttctctcacagagaaaactatttattccggagaggagaacatggacattaccaagagtcatacagttgcaatagataatcaaatttttaaacaagatcaatcaaatgtgcaaatagcagctgcaccaacacccgaaaaagaaatgatgctccaaaatcttatgaccacatcagaagatgggaaaatgaatgtaaattgtaactcagttcctcatgtatctaaggaaagaatacagcagagcctgtcaaatcctttgtctatttcattgactgatagaaagactgaactcttatcaggtgaaaatatggatttgactgaaagtcacacaagtaacttaggaagtcaggttcctcttgcagcttataatctagcaccggagagtaccagtgaatctcactctcagagcaaaagctcttcagatgaatgtgaagaaattaccaaaagtcgtaatgaaccatttcagcgatcagacataatagccaaaaacagcttaaccgacacctggaacaaagacaaagattgggttttgaagattttgccctaccttgataaagattctcctcagtcagctgattgtaatcaggagatagcaacaagccataatatagtctactgtggtggagttcttgataaacaaataactaatagaaatacagtatcatgggaacaatctttgttttctaccacaaagccattattttcatcaggacagttctctatgaaaaatcatgatactgctataagtagtcatacagtgaaatctgtactaggccagaattctaaactggctgagccactgaggaaaagtttaagcaatcccacacctgactattgccatgacaagatgattatatgttcagaggaagagcaaaatatggatctaacaaagagccacactgtcgtcattggatttggtccttctgaactacaagaacttggtaaaactaatttagaacacactactggccagctaacaacaatgaacagacagatagctgtaaaagttgaaaaatgtggtaaaagtcccatagaaaaaagtggagtgcttaaatctaactgtattatggatgtgttagaggacgaaagtgtacagaaacctaaatttccaaaggaaaagcaaaatgtcaaaatttggggaaggaaaagtgttggtggaccaaaaattgataagactattgtattttcagaagacgataagaatgatatggatatcactaagagttatacaatagaaataaaccatagacctttattagagaaacgtgattgtcatttggtgccattggcaggaacttctgaaactattttatatacatgtaggcaggatgacatggagatcactagaagtcacacaactgccttagaatgtaaaactgtctcaccagatgaaataactactaggcctatggacaaaactgtagtgtttgtagataatcatgttgaactagaaatgacagagtcccatactgttttcattgactaccaagaaaaggaaagaacagacagacctaactttgaactatcccaaaggaaaagcctaggaacaccaacagtgatatgtactcctactgaggagagtgttttctttccaggaaatggtgaaagtgaccgtctagtagcaaatgacagccagctaacccctctggaggaatggtctaataataggggccctgtagaggtagctgataacatggaattgtctaaatcagccacttgcaaaaacatcaaagatgtacaaagtcctggatttctgaatgaacctctatcaagcaaaagtcagagaagaaaaagccttaagctaaaaaatgacaagaccattgtattttcagagaatcataaaaatgatatggatattacccagagttgtatggtggaaatagataacgaaagtgccctggaggataaagaggacttccatttggcaggggcttctaaaactattttgtattcatgtgggcaggatgacatggagatcactaggagtcacacaactgccttagaatgtaaaactctcctgccaaatgaaatagctattaggcccatggacaaaaccgtattgttcacagataattacagtgatctggaagtcaccgattcccatactgttttcattgactgtcaagccacagagaaaatacttgaagaaaaccctaaatttggaataggaaaaggaaaaaacttgggtgtttcctttcctaaggataatagctgtgttcaagaaatcgctgaaaaacaagcactggctgtaggaaacaaaatagttcttcacaccgagcaaaagcaacaactctttgctgctactaatagaactactaatgaaatcatcaaatttcatagtgctgctatggatgaaaaggtcatagggaaagttgtagaccaggcctgtacattggaaaaagcgcaagttgaaagctgtcagttaaataatagagatagaagaaatgtggactttacaagtagtcatgcaactgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcaaccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaacaactaactataatacagctctagatttccacagtaactcagacgtaactaagcaagtcattcaaactcatgtcaatgctggagaagcaccagatcctgtaattacatctaatgttccatgttttcatagtatcaaaccaaatctgaataatttgaatggaaaaactggagagtttttagcctttcaaactgttcatctaccaccccttccagagcaattacttgaattaggaaataaggcacacaatgatatgcatatagtgcaagctacagaaatacataatattaacataatctccagcaatgctaaagatagtagagatgaggaaaataaaaagtctcataatggagctgaaaccacctctctaccgccaaagacagtttttaaagataaagtaaggagatgttctttgggaatctttttgcctagattgcccaacaagagaaattgtagtgtcactggtattgatgacctggaacagattccagcagacacaactgatataaatcacttagaaactcagccggtctctagcaaagattcaggcattggatctgttgcaggtaaactgaacctaagtccttctcaatatataaatgaggaaaatcttcctgtatatcctgatgagatcaattcttcagactctattaacatagaaactgaggaaaaggccttgattgagacataccaaaaagagatttcaccatatgaaaataaaatgggaaaaacttgcaatagccaaaaaagaacgtgggtacaagaagaagaagatattcataaggagaaaaaaatcagaaaaaatgagattaagtttagtgatacgacacaagatcgggagatttttgatcaccatactgaagaggatatagataaaagtgctaacagtgtattgataaaaaacctgagcaggaccccatctagttgcagcagctctctggattcaatcaaggctgatgggacctctctggacttcagcacttaccgcagtagtcaaatggaatcacagtttctcagagatactatttgtgaagagagcttgagggagaaactccaagatgggagaataacaataagggagttctttatacttctccaggtccacatcttgatacagaaaccccgacagagcaatctcccaggcaattttactgtaaacacaccacctactccagaagacctgatgttaagtcaatatgtttaccgacccaagatacagatttatagagaagattgtgaggctcgtcgccaaaagattgaagaattaaagctttctgcatcgaaccaagataagctgttggttgatataaataagaacctgtgggaaaaaatgagacactgctctgacaaagagctgaaggcctttggaatttatcttaacaaaataaagtcatgttttaccaagatgactaaagtcttcactcaccaaggaaaagtggctctgtatggcaagctggtgcagtcagctcagaatgagagggagaaacttcaaataaagatagatgagatggataaaatacttaagaagatcgataactgcctcactgagatggaaacagaaactaagaatttggaggatgaagagaaaaacaatcctgtggaagaatgggattctgaaatgagagctgcagaaaaagaattggaacagctgaaaactgaagaagaggagcttcaaagaaatctcttagaactggaggtacaaaaagagcagacccttgctcaaatagactttatgcaaaaacaaagaaatagaactgaagagctactggatcagttgagcttgtctgagtgggatgtcgttgagtggagtgatgatcaagctgtattcacctttgtttatgacacgatacaactcaccatcacctttgaagagtcagttgttggtttccctttcctggacaagcgttataggaagattgttgatgtcaattttcaatctctgttagatgaggatcaagctcctccttcctcccttttagttcataagcttattttccagtacgttgaagaaaaggaatcctggaagaagacatgtacaacccagcatcagttacccaagatgcttgaagaattctcactggtagtgcaccattgcagactccttggagaggagattgagtatttaaagagatggggaccaaattataacctaatgaacatagatattaataataatgaattgagacttttattctctagctccgcagcatttgcaaagtttgaaataactttgtttctctcagcctattatccatctgtaccattaccttccaccattcagaatcacgttgggaacactagccaagatgatattgctaccattctatctaaagtgccactggagaacaactacctgaagaatgtagtcaagcaaatttaccaagatctgtttcaggactgccatttctaccactagacccttggaccaccattggaacaaccaagcagaatgtacttgatattatttcagggtcccattgctgttcagcctttgtttttacgtcattacaagctgagtaaaattccttctgatgatgttatagttaatctgtatgttttttatatctctgcagaatgatggtgatgaagtctggatggtaggcctcatagcctactatcaacttactcatctttgtaccaaaggtttaagtaataggacacttaggaaaaatgtctcctaactaaactagtgctttctgctttagtacaagccctaaggattaacttaagtataagaagtgttatcactgacaagaacattagccattttcccataactagatagagctatgattttttaggttgcctggcttctgcctagcagatatttctggagtagaaatgtatctgtctacaaactattatcctttttctccgttactaaaatgctattaagagaaagtagggctgggtgcggtggctcacacctgtaataccagcagtttgggaggccaaaatgggtgaatagcctgagtccaggaattcaagaccagcctgggcaacatggcaaaaccccacctctacaaaaaatacgaaagttagccagtcatggtggcttgcgcctgtggtcccagctacttaggagcttaaggcaggaggatcacttgagcccaggaggcagaggttgcagtaagccgagaccattccactgcactccagcctaggcaacagagcaagaccctgtctcaaaaaaacaaaaagagagaaagcaatagcactcagctattgaaatggttgccatctttttttgaaggccttgctttttattctatggtgtctattatgttttctttttctttttttttgagacggagtcttgctctgtcgcccaggctggagtgcagtggcatgatctcagctcactgcaagctccgcctcctgggttcacgccattctcctgcctcagcctcccgagtagctgggactacaggtgcccaccaccatgccgggctaattttttgtctttttagtagaaatggggtttcacgatgttagccaggatggtctcgatctcctgacctcgtgatccgcctgcctcggcttcaaagtgctgggattacaggtgtgagccaccacacccagcaatgttttcttaataagtatagtttttctagggaaagttaattcatttttgtctagtacatatatgtaaatatattaatgttgtttttgtgtttgtgatgtagtaaggagatgtacatagaaattcattgaggtatatagatactcatctgtctaggcagttcccaattttctgaagaatgttttacagcaaaattttctattttcttttattaaatagtgacacgtcaaacaatgtcacatccaaaacactagtttcatcaatttctagcagtaataatagacttgctgtaagtattgttttctgatgccatacccttgtcatacatattattaaatgaccaatattatgtatgaagtagacaaaaaaatttactcaaacttcattcaaatcctaattgtgataatttttgttttatatttaattataaaccaaaatacatttgcatttttaagctaatttgtctcaaaattttgctttatatttttggatcaggttaaagtcctgtggatcccctgaatgttattgtccctcttgattggtttttacttctgagctatacgtcaaaagacacataagcttcaaaagtcaagacaaacctcatttgccataaaaatcaagatatagatgttctgttccgtaaactccttgaaaaacattttaaagtcatcaatatgatctgtttcccatgaaacttaagttagctttcttattggagttatttcttttctgtaagtctgaaaagtagagattttgttttacgcattttagtaacctgcaacaaccaactctaaaaaagatttggcttgtaatgacggtctctgcttttttgggtttggagtacacaattgtaatatttacttagttatttgtgtttttctttgttcaaggtattgactagtttcataaattttttgaaagtttttctttcattggttggaaagcagattacattttgcactattaaaataagtttattactttaaa

SEQ ID NO: 1284 - DNA, 5218 bp, Homo sapiens
cccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggt

SEQ ID NO: 1285 - DNA, 550 bp, Homo sapiens
gggctggcggccggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcgacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggactgcagtgacatgtacgagaaagtgctgtgcaccagctgtgccatgttcgagacctgaggctggctcaagccggctgccttcaccgggagccacgccgtgcatggcagccttccctggacgagcgctcggtgttcacactgaactgtggggtcgacgggaggggtgccttttacatgttctattttgtatcctaatgacagaatgaataaacctctttatatttgcacaaga

SEQ ID NO: 1286 - DNA, 2524 bp, Homo sapiens
gaagaggaggtggagaaggcttgggctcgcgccgctgaagaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 1287 - DNA, 7068 bp, Homo sapiens
tgttaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatgcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccagtgccatttttgtgacaaggcctttatgaaccaagcttttctacaaagtcacattcaacgccgccacactgaagaaaattctcattttgagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaaggaaatcctttagcctggcaggcttttgaatctcagccagctgctccagctgtgcctatgaatgccccagccctgcacactttggaaactaaatcaagtctgccaatggtgcatgaacaggcattctcgtcgcacatactggaaccaatagaagaactttcagaggaagaaaaaggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcagatcagtgcagtgtttctcaaatggataccctttcaactggagaagtacccaaaatgatacaacttccttccaaaaacagacaactgattagacaaaaagctgtttctactgataggacatctgttccaaaaattaagaaaaatgtcatggaagatccttttcccagaaagtcttcaactattacgacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggtactctagtgttaagtgtatttttttcaactaattttttagtgaattttttttaaacttacagcatgttttggtttgaattactaaaactttaaaaaatatttttcttatgtatgctgtcgtatcgtaggcgtttatattataaaattctgttagtagtcttaaaattgaattggtggaaccactaatccttaaaagttagtctggttatttttcatatagaagtaagtttaatccgagtgtggtggtgttcacctttaatcccagctacttgggaggctgaggtgggaggataacttgagcacaggagttcaagaccagcgtgggcaatatagcaagactccacccctccacaccccaaaaaagtaagtttaggattagaatatagctaggtccaatgttaaatacattttcctggagtacatttgtcacattcagctttgagccactgtaagcatgttactattaaatggttggttattttatatagcatattctttatcttggatattttatgaataaagtatagttattttaagtgccaattaatttatcagactaaatagaaaatatttgagccattactgaattcacatatgtatgtttttttttactatttaaaatacccaacatgtattatgaaatacctcaaaagtaatttagttacattcttaaacaatgacattgtcgaaagaaagttcttataagctgttttttgcatttttataacttggttatactatattctgtttccaagtaaccttttaactaaaagatttgttgggttttagatctcttttcatttgtcaaccttttcagtaaagccctctgttacatcactgtgactgtggctgtgttattagagatgaattctgagttaaatttgtacttattaggggtcttacagagggagaatctggccttgattgctatgccatatgacattctgtcctaatggttagaacaaatctttatctgtttccacccaccctgggatcctttttacttgtagcccattcctgccctctaaaagaatccttccaacttcctataggggccatttcatgcagatatactcactttatatgtatgtttctaaaagctttagtgaaggctgaatccaagtttcatgtagtaggacagagaacagaaggccgaatccaagtttcatgtggtaggacagagaacggcaatctacaaaactacaccaagcctaagatggcccatgtgccactttgttcattcatttatttattcagcagatatttattgaaccacttggtctggtttggttttgaacacgcactaattcatttaattacaacaactttgcgatgtagttattgttataatcctcatcctaaaggtgtgagaaacagagttattaagtaagttgccagaagccatacaagtacaaagtgtcaaggggagactttaagccaggtctctattccatgttttgtgtctgccatgttttcattcctgagcagaagagcttggggaaatgaacttttgctaagtaaacccagtatttaaattaagtcactatatctgtgtcttttaagagcccctcctttagcttacatggttagttgtatctttttttttttttttttttgagacagagtctcactatgttgcccaggcttgagcgcagtggcaccatctcggctcactacaacctccgcctcccagattcaagcgattttcctgcctcagcctcccaagtagctgggattacaggtgcccaccaccatgcctggcttaattttttgtatttttagtagagatgaggtttcaccatgttggccagactggtctcgaactcctgacctcaaatgatccgctgtcttgtcctcccaaagtgctgggattataggcgtgagccatcgcgccctgctgcatttcatttttttgtataaaatttggtttgttcgtttttgaggggaaccattcctttatgttgccccttactgatgcccaactaatgtgtttctggttactaacagaccttcatcccccaccctccctaaattcttcggtgtaatctaagcgttatctgcaccacttctgaataataaatgtgtttgaaatgcacacctacacaaccctgtcccacactggcctgtaggacctaatctaccttcatgtctttcagttgatttgtatttctgcaaaagatatttcaaggattatcaaggtatggaattttttttattttttatcttttaacaaacttgttcatttccttttctttccattgagcacctctgaacaatgtgattcttttttttaagtctttcacacttcaggaaaatactacattcacccacgttgtgattcatatcggacagtttcttactcaaagataacacaaataccaattcttattcatactttgaaactatattttaccctagactgccttggttcaaaggcctagtttcgacattactgtggcaaattatttaagctctctgttttcatttctttttctgtaaatgcaggatgaaaacaatatgtatctcctaggatggctgtgaggagtgagtgagacaggacatgaaaggtgtgtatgaactgtgataactgttgcccttgtgggcatgttatatagggctggctctaggaagaagcctgtgtcttttttcagaaatccctggagcaacttaaatgtctttagaaatgacaagtctctcagttatccagttagccgtaaacaggttctggaagacacacctagatagaactcggcccgtcagttctgagtgaggcacgtaccacttgggcttgggatgtccttaacccatttatgcctgaggttgcaattttttgaatttttccaatcacaccttggcgatgaccttgagcagtaggatataaataactcccacatgcttagtgttccaataatggaacactaggcataaacaggttttaattggctcctcagtcaaccatgaccaatatctctatctcagcttctgctgatgccctagctcagggctctgcattccgtgccagggacgcctcagccccttaacatggatgtgccacatgacaggcaataatatattggccccattagcccttcctggagcagtcataatgaattacagtcatgacaggcacatgtaagaaaccaaaatttgctaaatatgtacatgagtcttcatcacagcatcgtttatgaaaacaactaaatattcactaatggtgccagtggaataaatcagagaacatcccctgctacgtaactctctgcatacatcaaagagaatggtgtggctttgctttttcaacaatctactgagtggccatgggcatgtggatatggccatgaatgagcaagatcctctctgatcctgtagaagttaagttctaccagataacttgctgcttcaacaaaaagatttacctttttaaataaatgttgtagaatacttaaaaaaaacaaactagaatttgcctgtgtgcagccagtaacatgtctatttaacctggacaccttttgaggaatattctcagattgcccccatgctgtttataagacattgttccttatacacctgtttatgaatgaaaagaaacataaggagtgggtacaaagacttctatctatgaatgattaaaaaggctagagtacgaatacttcttgaacctttggtactaaatgcttttcatgttctatataaatgtagaaaacattttacaaatcctgtaaataaactgtttattttttatagaaagcc

SEQ ID NO: 1288 - DNA, 2404 bp, Homo sapiens
agacccgtcaaaacaattgcctcgagcggcagccatcatggatttaaaggggcagtaccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttctgtg

SEQ ID NO: 1289 - DNA, 1744 bp, Homo sapiens
gcacatttggctatttttcaaagagagcatgtagttcaagaaatggcttattttgttttttattcttctttttgtggtctatttaggaaaacaaaatgaaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccaggg

SEQ ID NO: 1290 - DNA, 2904 bp, Homo sapiens
gttcgcctctcttcggccctctactcaagagctccgtctccgtctcgccctcctcgaagtcctcgtcgcgcgcccgcgacccaggtcgccctgaaatctagcccgtccgagcgcgagtccaacgccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 1291 - DNA, 3136 bp, Homo sapiens
acttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaatggaagagaatccgaagaagaaaatctcaataaatctgaaataagtcaagtgtttgagattgcacttaaacggaacttgcctgtgaatttcgaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaagacacccataaagaaaccaggggatggaagaaaagtaaccttttttgaacctggctctggggatgaaaatgggactagtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggttgaatacaaagacttccccaaaaacaacaagaacgaatttgtatctcttatcaattgctcctctcagccacctctgatcagccatggtatcggcaaggatgtggagtcctgccatgatatggctgcgctgaacatcttaaagttgctgtctgagttggaccaacaaagtacagagatgccaagaacaggaaacggaccaatgtctgtgtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaa

SEQ ID NO: 1292 - DNA, 429 bp, Homo sapiens
gagtagatatcccggagttccgcgcggcgccagcccttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgac

SEQ ID NO: 1293 - DNA, 3792 bp, Homo sapiens
atggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaact

SEQ ID NO: 1294 - DNA, 4955 bp, Homo sapiens
gtgctgtggcggcggcggcggcggtagtggcggcggcggcggtgcctgggcggcagcagcagcagtagcggcagccctgaggacggtgagacggccgcggcggcggcgacagcgcggaagtcgcgcgggacccagagcttcccccctgtcgctagtgctgaggctttcgcctttcctacccagcttcttgctcacggcccgggctgggctgggcagggcaacgcgcccccggggaggggcggagctgtagatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctaga

SEQ ID NO: 1295 - DNA, 2998 bp, Homo sapiens
gccggcgggatcccaggcgccgagcgcccgctgagcagccaccctttgcgcgccgcctgcagcgcagcttccccgggcgctgcctggacaggcctgcctgcgtgctgggacatgtctggcctccaaggaccgtcggtgggcgatggctgcaacggtggaggggccagagctggaggcagctgctgccgcaggagatgcttcagaggattcggacgcagggtccagggcgctgcctttcctgggcggcaaccggctgagcttggacctgtaccccgggggctgccagcagctgctgcacctgtgtgtccagcagcctctgcagctgctgcaggtggaattcttgcgtctgagcactcacgaggaccctcagctgctggaggccaccctggcccagctgcctcagagcctgtcctgcctccgctccctggtcctcaaaggagggcaacgccgggacacactgggtgcctgtctccggggtgccctgaccaacctgcccgctggtctgagtggcctggcccatctggcccacctggacctgagcttcaacagcctggagacactgccggcctgtgtcctgcagatgcgaggtctgggtgcgctcttgctgtctcacaactgcctctctgagctgcctgaggctctgggggccctccccgccctcaccttcctcacagtgacacacaaccgcctgcagacgctgcccccagcactgggggccctatccaccctgcagcgcctcgatctctctcagaatctgctggacacgctacctcctgagattggaggcctgggcagcctcctggagctcaacctggcctccaaccggctgcagagcctcccagcctctctggcgggacttcggtccttgcggctccttgtcctgcacagcaacctcctggcctctgtgccagctgacttggcccgccttccactcctcacccggctcgacctgagggacaaccagctccgggacctgccccctgagctgctagacgccccctttgtgcgcctgcaggggaaccccctgggtgaggcctcgccagacgccccgagttcaccagtggcagccctcattccagaaatgcccagactgttcctgacctcagatttggacagctttcctgtgacccctcaaggctgctcagtgaccctggcctgtggcgtccgcctgcagttcccagcgggagccaccgccacccccatcaccatccgctatcggctgctgctgccggagccaggcctcgtccccctgggtcctcatgacgccctgctcagccatgtgctggagctgcagccccatggggtggccttccagcaggatgtggggctgtggctgctcttcaccccaccgcaggcccggcgctgccgtgaagtggtggtcaggacccggaatgacaacagctggggtgacctggagacctacctggaggaagaggcaccccagcggctctgggctcactgccaggtgccccacttctcctggttccttgtggtttcccgccctgtgtccaatgcctgcctggtgccaccggaggggacactgctgtgctcctcgggtcatcctggggtcaaagtcatcttcccccctggggccactgaggagcctcgtcgagtctccatgcaggtggtgcgcatggctggccgagagctgcaggccctcctgggagaaccagaggctgcagtgagccccctgctgtgcctgtcacagagcggtccccccagcttcctccaaccggtcaccgtgcagctgcctctgccctctggcatcacaggcctcagtctggaccgctcccgcctgcacctgttgtactgggcccctcctgcagccacctgggatgacatcacagctcaggtggtcctggagctcacccacctgtacgcacgcttccaggtcacacacttctcctggtactggctctggtacaccaccaagaactgtgtgggaggcctggctcggaaggcctgggagcggctgcggctgcaccgtgtgaacctcatcgctctgcagcggcgccgggaccctgagcaggtcctgctgcagtgcctgccccgaaacaaggtggacgccacccttcggcggctgctggagcggtaccggggccccgagccctctgacacggtggagatgttcgagggcgaagagttctttgcggccttcgagcgcggcatcgacgtggatgctgaccgccctgactgtgtggagggcagaatctgctttgtcttctactcgcacctgaagaatgtgaaggaggtatacgtgaccaccactctggaccgggaggctcaggctgtgcggggccaggtgtccttctaccgtggcgcggtgcctgtgcgggtgcccgaggaggctgaggctgcccggcagaggaagggcgcagacgccctgtggatggccactctgcccatcaagctgccgagacttcgagggtccgaggggccacggcggggggctggcctctccttggcacccttgaatctgggagatgccgagaccggctttctgacgcagagcaacctgctgagtgtggctgggcgtctgggtctggactggccagccgtggccctgcacctgggggtgtcctaccgggaggtgcagcgcatccggcacgagttccgggatgatctggatgagcagatccgtcacatgctcttctcctgggctgagcgccaggctgggcagccaggggctgtggggctcctggtgcaggccctggagcagagtgaccggcaggacgtggctgaagaggtgcgcgcagtcttggagctcggccgccgcaagtaccaggacagcatccgacgcatgggcttggcccccaaggaccccgctctgcctggctcctcggctccacagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttca

SEQ ID NO: 1296 - DNA, 5913 bp, Homo sapiens
agagccctagtgtcgtgctctcctcggtaggggaggaattggttaggcggcggcggcggcgaagcggcggcggcggctgtaggggagcagcggcagtggcggcgacggcgaggaggtgttcggtttgcgcagcgtagaaacgcccgcagcttcagagaaggagttcttgtgggaccaaattaggcattctgaacccacgccggcttagctgggccgagtccaggcgctgccgcacgtacagttttggtggcggtgacagacactgttcttgactctaggggcctattaggccgacgtctgaggcgcagatcgctggctctcgacgcattactctttacgccttacatttctgtcttccttcctgggtcagtgattcccggaccctggaagagaagagggtggctaatgattaaggctttccttaaagtttcccatgtctcaatggactcctgaatataacgagctctacaccttaaaagtggatatgaagagtgagattccttctgatgcaccaaagacacaggagagtctgaaagggatccttttgcatccagagcccattggggcagccaaaagttttcctgcaggagttgagatgattaatagtaaagtggggaatgaattctctcacctgtgtgatgattctcaaaagcaagagaaggaaatgaatggtaaccagcaagaacaagaaaaaagtctcgttgtgaggaaaaaacgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggactgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggagatgactcaaggagaactacatctagtgctgtaacggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccacccagctgtcccagtttctccttcctttagtgatcctgcttgccctgtggaaagacctccacaagtacaagcaccttgtggagcaaatagtagttctggtaccagctatcatgaacagcaggcattgccagtggacctgagcaacagtggtatcagaagtcatggaagtggcagttttcatggagcatctgcatttgacccctgctgccctgtttcttcctcccgagctgcaatctttggccatcaggccgctgctgctgccccaagtcaacctttatcatcaatagatggctatggatcaagcatggttgcgcagccccagccccagccccctccacagccctctctctcatcatgtcgacattacatgccacccccttatgcctctttgacaaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagccacagcacctccagcacagagactgcatcctcatgaagtgatgcagaggatggaagttcaaaggaggaggatgatgcagcatccaacgcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttctattgtctttgtgtttcataattagtttttataaaaacagtttacattaaacatcttggaattcaacaatagtgatctcactcaaattgacatttgcataatttgacatttatattcattcagttatgactacttgcccttttcttcatattagtaaatgttacactgtagtagttgtcaatgttaacaggcttcaacatagtatgtgtgcagatggacgatggatttaaagagcataccttatgattaaaccgaggttatagaaggtcaggggagagtgaaggagtcagtgacctatgtctgccatcttactggggaaaagagcaagtagcctgtcttcctttaagtaagtagcctgtaatggatgtactactttgccactggaataccccgggtctgtgccaagggactgaagaagtgtaagatggggagaactgtatgtcatggagtcctcttgacgttcccccagatacaagtaaagcacaggtggatttctctatttttgaatactacatcagatttagatgcacgactacctgttgacttgttttataattgctactgatttttttaatgtaggcaaagctttgttactttgaaatttatttaataaaagtatttgtgacataaacctgaattgttaatataggagcttattaagctactgccattagttatcgaaaaatgtgataagtaatgaagaaagtaaggaagaaaatgactttgaacattttgactttttgtgctttgttttggtgtcttccatatcctgctgcatcttatatgtcaaaatgaacatttcagtggtagctgtccaaatacataaaaactaaaattcttttgttagcaagtccttatttttattgttgttaacatgcaagtgataaactgataatttgaaacatttttcttactctggtgactttcttttagctgctagcacacttcagcatttgaaccataacagttgtgataaactgatcgtttgaaacgtt

SEQ ID NO: 1297 - DNA, 455 bp, Homo sapiens
cttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgag

SEQ ID NO: 1298 - DNA, 2502 bp, Homo sapiens
cgctttggggttctgtgtgcagcgagcatggtgtccttggcaccagggtttcggcagaggagcctagcgtgggcctacttggactcctccgcgtggggcagctcgggacacccgggcctgcaggagagcggggttctaggctggccccggctctgcagtgcagccgggtgcctgccactcgcggggctctgtcgcagtactcgtgcctggcgcctcccctcagccacagagaccgcagtagctccaaccatcgcacccctaactgggccacgagttctctgattgccagacctgttgtctttgccactcactgttctgagtaattggagagtcgtgtattcactacacgccaaccagagtggtcctgtaaaagcgtaagcctagtgtagatacgcttctgcttaaaactcttgagtggctcccagtgcttttagaacaaaatccaaacgcctttccgaagtcgacaaggcccagcttgattgagcagaagatgtgataggagatgaggagcggggggcttctgcaaaagtgcttcggtcgctcaggcttttggcacattttgcttatgcaacctagttctttctaccttagggccttttcttgggaaagttgggagtctcactctgctgcctaggctgagtgcagtggtgtgatcgaggcgcactgcagccttgacctcctgggctcaagcgatcctcacctcggcctaccgagtagctgggactacaggcacgcgccactacactcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcagtggcgggaccactggatgcagtgtgtgtacttcctgccacaagaggagcctgtggtgcagggctcagcgctctatctggtagcccaccacgatgactactgcgtatggtacagcctgcagaggaccagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggacctgtggcggatccggagcccctgtggtgactgcgaaggcttcgacgtgcacatcatggacgacatgattaagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcaccgtggagctcagaaggcccgggcagagccacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctggg

SEQ ID NO: 1299 - DNA, 1887 bp, Homo sapiens
tcctctcctattatgcaaacccacaccatggatccagcagactactctggccccagcatgctgctccttgggatgatgggagaagggggaaacctgtgttttctcttggttttagggtatgggtctacttctttgaacattcgctcagatcgtaaggtaaccccaagaatcggcatcactctctggtctgggcgcctggatagtcacgcatggagtccgcgaggtgctggcgccggagcacgctgggaacgccgggctcccggccggcctgacccggaagggctggcgcatggtaaccccagcttccctagcaaccaagcaggcgcaagaagcaaccagccgcgctatccgctcccgttgctaccggaatgcctcttcaggttagcgattacagctggcagcagacgaagactgcggtctttctgtctctgcccctcaaaggcgtgtgcgtcagagacacggacgtgttctgcacggaaaactatctgaaggtcaactttcctccatttttatttgaggcatttctttatgctcccatagacgatgagagcagcaaagcaaagattgggaatgacaccattgtcttcaccttgtataaaaaagaagcggccatgtgggagaccctttctgtgacgggtgttgacaaagagatgatgcaaagaattagagaaaaatctattttacaagcacaagagagagcaaaagaagctacagaagcaaaagctgcagcaaagcgggaagatcaaaaatacgcactaagtgtcatgatgaagattgaagaagaagagaggaaaaaaatagaagatatgaaagaaaatgaacggataaaagccactaaagcattggaagcctggaaagaatatcaaagaaaagctgaggagcaaaaaaaaattcagagagaagagaaattatgtcaaaaagaaaagcaaattaaagaagaaagaaaaaaaataaaatataagagtcttactagaaatttggcatctagaaatcttgctccaaaagggagaaattcagaaaatatatttactgagaagttaaaggaagacagtattcctgctcctcgctctgttggcagtattaaaatcaactttacccctcgagtattcccaacagctcttcgtgaatcacaagtagcagaagaggaggagtggctacacaaacaagctgaggcacgaagagcaatgaatactgacatagctgaactttgcgatttaaaagaagaagaaaagaacccagaatggttgaaggataaaggaaacaaattgtttgcaacggaaaactatttggcagctatcaatgcatataatttagccataagactaaataataagatgccactattgtatttgaaccgggctgcttgccacctaaaactaaaaaacttacacaaggctattgaagattcttctaaggcctacaggattatgaagcggcacttaagattgatccatccaacaaaattgtacaaattgatgctgagaagattcggaatgtaattcaaggaacagaactaaaatcttaatgactattagaagtaactaagtattgttataagttttttaaaaacaactggaggcatctttgtacatattatggccagttgtacagaatcgctttctgtttagtactttagttctgttgagggcaaaatattataaatctatagaaaataaactgtttgacttgaatcatttctgaataagtaaatctaaataagaatctattttaattccttatttcttcatattaatacatatgtatacttttttgtgttactgaattaagcttgcccttgtaacaaaatatgttttggtatagttaccaggacacttactgattaatttttaacaaggtagaattttaaaataaaagatttataaataa

SEQ ID NO: 1300 - DNA, 5083 bp, Homo sapiens
atgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctagggtttgaagggtgttccatggtgcctaccatctaccctctggaaacactgcataatgccctttccctacgtcaagtgagtgaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggttagagacaaggttttgccatgttggccaggctggtttagagctcctgacctcaagtgatctgcctgcctcggcctcccaaagtgctgggattacaggcgtgagccaccgcacccagccagacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgt

SEQ ID NO: 1301 - DNA, 2783 bp, Homo sapiens
gaaggggcggagctccgcctacgaaggctgagcatcgccgcaagaggcggagtctggagcgaggcggagctctcctaggggcggggaaaatggggcggggcctccggacagggggcggagcgtggctgttcgcgctcatccccctcccccggccctgggtgtccccgtgacgaggcagcgcggagccgccgcgggccgggcccatcccgccgcagcggcccggggccgagcaggggctaggcggggagggagcggcgcccagcggggcccggagcgtggccagaatggtgctggaaggaaaccctgaagtggggtccccccgaacctcagacctccagcaccgggggaacaagggctcttgcgttctctcctctcccggtgaagatgcgcagccaggcgaggagcccatcaagtatggtgaactcatcgtcctgggctacaatggttgtctggcaagtggggacaagggccgccggcgaagccgcctggcactgagccgccggtcgcacgccaacggggtgaagccagacgtcatgcaccacatctccacgccgctcgtctccaaggcactgagtaaccgtggtcagcacagcatctcgtatacactgtcccggagccactcggtcatagtggagtatacacatgatagcgacacagacatgttccagattggccgctccacagagaacatgattgacttcgtggtaacagacacgtcccctggaggaggggctgccgagggcccttctgcccagagcaccatctcccgctatgcctgccgcatcctctgtgaccgccggccaccctatactgcccgcatctatgccgctggcttcgatgcctctagcaacatcttccttggagagcgagcggccaaatggcggaccccagatggcctgatggatggactgaccaccaatggagtcctggtgatgcacccggcaggcggcttctccgaggactcagccccgggtgtctggcgggagatctcggtctgtgggaatgtgtacacattgcgggacagccgctcagcccagcagcggggcaagctggtggaaaacgagtccaacgtgctgcaggacggctctctcatcgacctgtgtggggccacactgctgtggcgcacaccggcggggctgctgcgggctcccacactgaagcaactggaggcccagcggcaggaggcaaatgcagcgcggccccagtgccccgtgggcctcagcactctggccttccccagcccagcccgtggccgcacagcgcccgacaaacagcagccctgggtctacgtccgctgcgggcacgtccatggctaccacggctggggctgccggcgggagcggggcccccaggagcgcgaatgtcctctctgccgccttgtggggccttatgtgcctctatggcttggccaggaggccggcctctgcctggaccctgggccgcctagccatgcctttgcaccttgcggccacgtctgctctgagaagactgcccgctactgggcccagacaccactgccccacggcacccatgctttccatgccgcctgccccttttgcggggcctggcttaccggcgagcatggctgcgtccgcctcattttccagggcccgctggattaggctccctggggccccctgctgctgtgcccacctgcccacccaggtccccacctcctgcagcccagagggagctctgcatgtgggacactccctgctggcacagccacaccagatggacatgttggatgggctgtgcccttccccccaactgtggccccccaaggaggtccccaagatctccaccccagtcatgctgatggggccttcagcaccagctctgtcctgggtcgatggaggaaagcccagccccatggccttgcccttcctggggcatcccacatcgtgccgccgacactgtgtgcccctgggggagtgaaggggccaggggcctttgacccccagcttaggctggctatgccctgagcctgccaacccagtttcagacactcatccttcatccttcctgctgccgccctgggttcctctataaacctcgctgctcagctgcccccacaagtcccacatgccccgcatgcgtgcaatgcctccagcccccaagtgagtggtgggtgggtggcaggctgggcctagcacttgctgatagccactatgggctcgactctgtgctaagtggtatctggggacacagaggcaatcagacctggttccccccctggtggagttcacagtctagtggaggacagactgttaacaaatggcaacacggcttcatgcgtgccaggatcagagtacaaatcaggctgtggcaggcctcactggtaatggaaaagtgagggaggcttcacggaggaggtgtcataggagctcagcctcaacggctgctcggaaccctccgagtccacaagatgggaagcaagtccacaagatgggaagcgtgctctatacagaagggagggcctgtgcacaggctcaggtgtcagtaagccagaaatccagggacagagtcaggatggctggagcatggactgcggggggaacagagaagggggtggagcaaaaggttgggaccatgtgaccagggaagatgctggatggaggattctgaacctcatttgtggacggtcaggagtcaacaaagggaggagagaggactcactggtcaagagtgtcggctgtgacacaagggccatcatccctgaatgcccaccatgtgccccgcactgtgctgatgatgataataataactacgtccattgagca

SEQ ID NO: 1302 - DNA, 1950 bp, Homo sapiens
atggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgtgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttga

SEQ ID NO: 1303 - DNA, 2544 bp, Homo sapiens
ggcgacgggtcggcggagacagaaaagcgccggacgccggggtgatcatggacgcttgacaacctgcgggcaggcgccgggaggccgagccagcgactaagaggaccgagaggtggcgtggacagatttcaaggccagagaatggcaggggaacagaaaccctcaagtaatctcctggagcagtttattttactagccaaaggtaccagtggctcagccctcactgctctcataagccaggtcttagaggctcccggagtgtatgtctttggagaacttctggagctggccaacgtgcaggagcttgcggaaggagctaatgctgcttatttgcagttgttgaacctgtttgcctatgggacatacccagattacatagccaacaaggagagcctgccagaactgagcacagctcagcagaacaagctgaagcatcttaccatcgtgagcttggcatcaagaatgaagtgtatcccctactccgtgttgctgaaagacctggagatgcggaatctccgggaactagaagaccttatcattgaggctgtctacactgacatcatccagggcaagctggaccagcgaaaccagctgctggaagtggatttctgcattggccgtgacatccgaaagaaggatatcaataatattgtcaagaccctgcatgaatggtgtgatggctgtgaagcagttctactgggcatcgagcagcaagttctgagagccaaccagtacaaagagaaccacaaccgaactcagcagcaggtagaagcagaggttaccaacatcaagaagacactcaaagccaccgcatcctcctcggctcaggagatggagcagcagctggctgaacgggagtgtccccctcacgctgagcagaggcagcccaccaagaagatgtccaaagtgaaaggtctggtctccagccgccactagggccggctggggcagctggcactcaccaggcctgggtcaggtggggaggggacaccaagggcccatttcctcccctctctacctgcagtgagttccagacctgcccgtcccctcaccagcgcctccccaccctgttggtactgttccagaaaaactgttactccccctcacccactccctccttccccagttgttcccttcagactcaggggctccaccaatgccatcccaaaacagggtcagacactgcccagcttccctccaggaggttcttgtctctgtgtaagggcttgtctccctcccagtttttcttttgctccacgtcattttgtcaggctggttataagccggaggcagctttaaccagcccccagggatgattgtgaaggaggcccctccccttgtgaggagggggcactcctctccagcccctggtaccacagtcctcacgatggtgcagtgatttctagccaggcgtcaagatgcgctgctttccctctcctgcctcatcccttgttggcagctccagttcaggccgtggagggacgtgatgctgggctgtgtttactaaacccacgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcccccctcgtgtcaatatttgttatagactaatcgccggggatttttcacctggttggagggtgggggtggggtggggtgtgtgtgtgtgtgtgtgtgtgtgtgtgtgtgtgtgtgtgtgtttgtaggtcctggactgattaaagttcattgaggaaaaagcacattttacaacaaaaaaataaaagtgtagatttaatgtatgtgactggggtttggggttgcatacctggtggatcttgaggggctgggattagggtggttcaggaaaatgtgatgctgtttccccatgtttagccatggtcaaaaaatggatttctcctttttctaaaatgtccagcaactgcctactgttgatcaaatgttgaagtattcttgtttcccttttaagccaatccatgtgcccacataacattatgcccaagtggagagttcactttaatttccaaagtatgtttcatgcagccccctgtcagctgctctgtggaaaaggggttctgttatgaaataaatgttgcactccctgcatccca

SEQ ID NO: 1304 - DNA, 1177 bp, Homo sapiens
tcctgtcactggcttatatggacacgtcagcccaccgtcacgtgaccgcaggctgctaaaaacagctccagcacccactccaaaccagggcctgaaacaatgtcctccaccgagagaaacgtaaaggacacttgatcacacaatccctggaataatatccaggaaacacttgctggagccactcgcagcacccttccctggcagcacacttggggacagcgaggagatgagcgcatctctgaattacaaatctttttccaaagagcagcagaccatggataacttagagaagcaactcatctgtcccatctgcttagagatgttcacgaaacctgtggtgattctcccttgtcagcacaacctgtgtaggaaatgtgccagtgatattttccaggcctctaacccgtatttgcccacaagaggaggtaccaccatggcatcagggggccgattccgctgcccatcctgtagacatgaagtggttttggatagacatggggtatatggacttcagaggaacctgctggtggaaaatatcattgacatctacaagcaggagtccaccaggccagaaaagaaatccgaccagcccatgtgcgaggaacatgaagaggagcgcatcaacatctactgtctgaactgcgaagtacccacctgctctctgtgcaaggtgtttggtgcacacaaagactgccaggtggctcccctcactcatgtgttccagagacagaagtctgagctcagtgatggcatcgccatcctcgtgggcagcaacgatcgagtccagggagtgatcagccagctggaagacacctgcaaaactatcgagattggatttgaggctcctcccctccagggacaggctgcagctccagcgagtggcagtggagctgattctgagccagctcgccatatcttctccttttcctggttgaactccctaaatgaatgatattcattccaactgctgcccctctgtctgcctggctgagatgcatgtgggcagcaggaagcccaagtgaaattaatattatgcagatgatgaaagggacctctgaacaggatttctgcaaaaatagccccaaactgcaattccatatgacttatctaacatcttggggggaaagaatattttgagaaaatagttgcagaaagcactggaaataataaacttgat

SEQ ID NO: 1305 - DNA, 3654 bp, Homo sapiens
ctggtctgcggctgagatacacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgtaaggattgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatgtaagaaagaacccacactctatgatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctc

SEQ ID NO: 1306 - DNA, 2487 bp, Homo sapiens
gaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagttacctggaagactggccaggtggaacgaggcagggcctggaagccaccagcctctctcgccctctgtagcaggagctgcgactctatggtttcatgttacgcttccattctgtgcaaggctctgtggaaggagaagctgcacacattctggcatcataacagaatttcatttcttccatctgcattcaggccaataccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacagagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggactt

SEQ ID NO: 1307 - DNA, 1425 bp, Homo sapiens
ccgagcgcgttgctgcccggaggctcctacgccacggcccgtcgggcccggcgccggaagtgagctgttccgaggcgccgccgggagctgccacgtccgagacctggagcagccaccgccgcaatcatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccagacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataa

SEQ ID NO: 1308 - DNA, 2628 bp, Homo sapiens
tcccgcctccttctgcgaaccgcaccacccagatcccggggtgcgcggagggcgcgtctctgacggaagccggggcggacggtcggagtccggaagaaaaacagtccgcgacagctaggcgcgtgagaccggccgcccgcagggctgctctggccgggacccgctggccgggagacgcgaacctgccggaccaccgcgcggggacgacggcggccatgagctcgcggaagctgagcgggccgaaaggcaggaggctcagcatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcct

SEQ ID NO: 1309 - DNA, 2146 bp, Homo sapiens
gtcccgttaccgcctcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggggaggaagttgccttgtactgtgccaaatatcttcctgatatcatcaaagatcagaaggcctacaaggaaggcaagctacagaaggctttagaagatgccttcttggctattgacgccaaattgaccactgaagaagtcattaaagagctggcacagattgcagggcgacccactgaggatgaagatgaaaaagaaaaagtagctgatgaagatgatgtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggggaccacttctataagagaaacaagaacctgccacctgaggaacagatgatttcagcccttcctgacatcaaggtgctgactctcactgacgaccatgaattcatggtcattgcctgtgatggcatctggaatgtgatgagcagccaggaagttgtagatttcattcaatcaaagatcagccagcgtgatgaaaatggggagcttcggttattgtcatccattgtggaagagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacct

SEQ ID NO: 1310 - DNA, 3919 bp, Homo sapiens
atgctacaggccttacagcttcgtactggcttcttctgttttagggtgttggtggcactttctccctgtgctttgcatgactctggcagacttaccacaggatcattcaacgttgtcagggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgtaaggattgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagagtacagttgaccaaaagcgtgccagccatcatgagagcaatggctttgccggtcgcattcacctcttgccagatctcttacagcaaagccattcctcctccacttcctccacctcctcctccccatcctccagccagccgacacccaccatgtccccacagacaccccaggacaagctcactgctaatgagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctc

SEQ ID NO: 1311 - DNA, 2643 bp, Homo sapiens
aagttaagctgaagaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgcgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtcccccccctttttttttttacccctgcttctcccacggcttcacctccctatgtgaactgtagactcagatcccaataaagtgctgttgcagct

SEQ ID NO: 1312 - DNA, 2453 bp, Homo sapiens
ggaagtgcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggactt

SEQ ID NO: 1313 - DNA, 4781 bp, Homo sapiens
acgcgcatggaacgcagcgaaggactatggcaggggagaacttcgctacgccgttccacgggcacgtgggccgcggcgccttcagcgacgtgtacgagcccgcggaggacacgtttctgcttttgaacgcgctggaggcagcggctgccgaactggcaggagtggaaatatgcctggaagtagggtcagggtctggtgtagtatctgcattcctagcctctatgataggccctcaggctttgtacatgtgcactgatatcaaccctgaggcagcagcttgtaccctagagacagcacgctgtaacaaagttcacattcaaccagttattacagatttggtaggaagtcacggaatagaggcagcttgggctggtggcaaaaatggtcgggaagtcatggacaggttttttcccctggttccagatctcctttcaccaaaaggattattctatttagttaccattaaagaaaacaacccagaagaaattttgaaaataatgaagacaaaaggtctgcaaggaaccactgcactttccagacaagcaggccaagaaactctttcagtcctcaagttcaccaagtcttagcatacagtgtgtgcccagaactactggaaactgaatgcatttagcatattttgaaactgaagtcattcattaggtaacaaggaattttatcagaaatttgtcattaaaaaaaggtagaaaggtggaacattccctttcagtcaggcctatagaattatttgcacaagtacaagtaaatatgtgtattatatttatagtttgcattttaaatataaaaattatgtatgaaatatttatttcagcattatgtggtaaggcaatggaattgatctggcaaatgtcttttttttcataccagtccataaaggcagtttgctttcagatggcagggccagcaacacaccttcattgtcgtatctccggtgtgtatcagctctccaactctatgtcataattcagttcatggggatcttgattacctttcccttccacaaaatattacactgattggttatatcgatgacattatgctgatttgacctagtgagcaagaagtaggaactacattagacttagtggaaagacatttgcatcagagggtaggaaataaatatgactacaattcaagggccttctaccttagtgaaattggtagggatccagtgacatggggcatgttaggatatttcttctacggtgaaggataagtacttgcatcttgctgctcttaaaaccaagaaagaggcacaatacttagtgggcctctttgggttttggaggcaacattttccaatttcattatgttataccagcctgtttaccaattgactcaaaaagctgctagttttgagtagggcccagaacaagaaaagagtctgcaacaggtccaggctgctgtgcaagctgctctgccacttgggtcatatgatccagcagatccagtggtgtttcagtggcagtggcagatagggatgctgtttgaagcttctggcaggtccctataggtgaatcttggtttaggattttagagcaaagccgtgccattaccaacaaataactagtctctttttgagaaacagctcttggcctgctactgggccttagtagagactgatacttaatgagtcaccaagttaccgtgcaacctgagcttcccatcatgaactggatgttatctgagccaccaacgcacaaagttggatatgcacagcaacactctgtcatcagatggaagtggtatacacatgattgggcctgagaggccctgaaggcacaaggaagttacatgaagaagtaggccaaatttccgtagtccccacttctgctacctgccttctctcttccagcctgcatcggtggcttcatggggacttccctgtgatcagctgacagagaaagagaagacttaggcctggtttacagagtgttctgtatgatatgcaggtaccaccctaaagtggatagctgcagcactacatctcacctctgggctaccttgaaggacagtggtgaagggaaatcctcctggtggacacaactttgagcagtccccctgttgactttgcttagaaggaaaaatagccagatattcaattatatgccaattcataggccgtggccagtggtttggctggatggtcagggagttcaatataactggaaaattggtgacaaagaaatttggagatgaagtatgtggatagacactgaatgggcaaaaagggtgaagatatttgtgccccatgtgaatgctcaccaaagggttagcaaaaaaggattttaataaagtggacaagataacctgttctgtggatactagtaggcctctttctccagccacacctgtcatcacccaattgtttcatgagcaaagtagccatggtgacaagaatagaggttatgcatgggctcagcaacgtggacttctactcaccaaggctgacctggccaaggctatctctgagtgcccagtctgccagcaacagagaccaacactgagcccctgatatgacaccattccccagggtcatcagtcagttgcctagtggcaggttcattacattgatccacctctatcattgaagggatagtgttttatccttactgaaatagatcttactctggatacagattcactttcccttcgcgcagggtgtctgctaaaactaccatccgtggacttacagaatgtctcatctatgaccatggtattccacacagcattacaagaaactcagttcacagcaaaagtgtggcagtgggcccatgatcatggaattttcttaccatgttccctactatcttgaatcaactggctacatagagcagtggaatggcattttgaagacagtaataacaccagctatatagcagtgccttgtagggctgggacaaggttctctagaagactgtctatgctctgaatcaacatccagtatatggtgcatttctcttatgactgggattcacaggtccaggaatcaaggggtcagaataggaaggacaccattcgctattagccctggtgacccactagcaaaatttttgcttcctgttcccatgacttatgcactgctggcctagaggtcttacatagggtggaatattttccactgagagacgcaatcatgatttaattgaactggaagtttaagactgctcctcagccatttggggcttcttatgcctctaactcaatagacaaatgagttacagtgctggctgggtgattgttcctgactaccaagtagaaactggactaccccgaatggtggtaaggtaaagtatgttgggaatacacaggattccttagggcatctcttagtgttatcatgccctgtgattaaggtcaatggaaaactacagcctaattcagacaggaccactaatgatccagacctttcaggaatgaaggtttgggtcaccaccaggtaagtaccatgaccagatgaagtgcttgctgaaggcaaagggaatacagaataaatggtggaataaatactagctttgatcatatgaccagttacagaaacacagactgtgattgtcataagtatgtcctccatattttgctataactacattttgtgtgtgtgtagctttgttttcttctcatttccttattctgtaacataagatgcattgattttatagcatagtgtttaaatattgttaatttttttaactggctccagtgttcaaccttgattaattttacatcatagtatttaagttatgggatatcaaggagagagtaaacatcacatgaagactttaccacctcttctgggaaacgggttaaagtgtttctggtggaatgctggattgttaatcgtgttagatggaattatgaccttgttgttgtctttatgtggcagttaagtatggtttaaagagatgtttatgggtgccaagttgacaagggtaaacttgtgatggttaattttatatgtcaacttgaataggccacagggtgccaaatatctgtttaaacattattctgaagtgtcttgagtgtgtttacagacaagatttgcatttgaactgggggactcagtaaaggagatagccatccccaaggtgggtggacatcatccagtttgttgagggcgtaaataaaataaaaggcagaggaaggaagaattccccccccttttttttcctgcctcattgtttgagctgtgacatctcatcttctgtcctcagatggatttacatcactggcttccctggttctcaagcctttggattcagactgaattataccacaggccttcctgggtctccagcttatagatgacagatcatgggacctcttagcctccataatcatgtaagccactttcttgtagtactggtaaaagatatattaaaccaatctataaaacagatagctatgaaagagaaaggtgacaggcacaagcctaggcaaatagagaagggttcctggacagcctctgacttgcctaggtcattgtgcacacgtggcttgcctgaatgaacatgcccactgtgaaagattccatttctcaacacatgtgcagtaagggaaataaatcaatgtggctcaaactaaccgcccacacatggggtggagccacaaggagtttgctccttatgcaggggagaagccgtgcctcttcagctcgtgtgtggtggcctggcattcaatttgtgaggtgtaaaacctgcatgaaggacccctctttttgtggagagctttccttttgcctaataaattctgccctcctcgcc

SEQ ID NO: 1314 - DNA, 4750 bp, Homo sapiens
accactgaccgggacaaaaccctgccaggcatcagaaagctccgcagttcttgagttccacatgcagagcagatgcgacagctagaagtgagtagggcccagaccctggcccaggaagatccactaaaggaggccatccttccgccttcttctgcaggagtcaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggtttccctgctcctcctaaacaattggacatgggagatgaagtttacgatgatgtggatacctctgatttccctgtttcatcagcagagatgagtcaaggaactaatgttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcattctgctgtgttcattaggtgccaatgtgaagtctggattttaattggcatgttattgggtatcaagaaaattaatgcacaaaaccacttattatcatttgttatgaaatcccaattatctttacaaagtgtttaaagtttgaacatagaaaataatctctctgcttaattgttaactcagaagactacattagtgagatgtaagaattattaaatattccatttccgctttggctacaattatgaagaagttgaaggtacttcttttagaccaccagtaaataatcctccttcaaaaaataaaaataaaagaaaaaggaaaatcattcaggaagaaatgacctgtctaaaaaaacctaaggaagaataataatataagaaaggaaatttaaaaacattccacaagaagaaaaattattgtttatacttctacttatggttatatcttatattctctattcaagtgacctgtcttttaaaaaggcagtgctgtcttacctcttgctagtgggttaaatgttttcaaaaattatagcagtagtagaagttttgtataaaatttgtccttatttgttaattgtatataaatgttaattatttgatacgaatgttatgcatttagtatgcacattgaagtctaaactgtagaagagtctaaaacaagttctctttttgcagattcacatactaatggtttaattctgtgctctgtttaaagtactattataactagagtagatctgaatgaggataaccctaaaatcatgaggaatggaagaatggaccttgaaactacctaggcttttatgcatggcacctctttataatgaagacactttttaaagtttttgtttttgtttcaattaccgctagatttttttttctctttttttaaaatccattttactggaaagttggccagcagagggagtagaaattattaaaattctagtgtttggattgggcccttctctaacagtacatactcattcccaaagcaatccaaaaacaaaatgtgaaccatttgggtttcaaatgttaagaacactaaatagcatgatttaaaaaatgaaaaatgctaacacccaagaaaagaagatattaagtgctttttaacaactcctagagtacaaaatgagtacatcataatgctggctcttctactaatgaaccatcgagtgatattgaataaattatttatcttctcagtttccttatctgtaaattacaatattagactaagtaagtttttccaactcttcactaccaattaccttaggcttttataatgctccgcctacttcagtcccatgtttcagaagcttttgtctattttttaaactcattgattaaataatgattaatgcattctccacattttaatattgcaaaggcccattggagtttctgaagtggctccacagaattgaaataatttcaaataactgtaaaggaactgaaaatcttcacagagatgaagtggggtttccattaggtgctttgaaatttgataacaaatcatcaacttccactggtcaatatatagattttgggtgtctgaggccccaagattagatgccactaatctccaaagattccctccaattatgaaatattttaatgtctacttttagagagcactagccagtatatgaccatgtgattaatttcttttcacactagataaaattacctggttcaaaagtggtttttgtttattaaatttggtaataaatatatataatacacagacaggatagtttttatgctgaagtttttggccagctttagtttgaggactccttgataagcttgctaaactttcagagtgccctgagacacttccagccatccctcctcctgccttcattggggcagacttgcattgcagtctgacagtaattttttttctgattgagaattatgtaaattcagtacaatgtcagtttttaaaagtcaaagttagatcaagagaatatttcagagttttggtttacacatcaagaaacagacacacatacctaggaaagatttacacaatagataatcatcttaatgtgaaagatatttgaagtattaattttaatatattaaatatgatttctgttatagtcttctgtatggaattttgtcacttaagatgagctgcaaataaataataccttcaatggataaccttgcctcctacttc

SEQ ID NO: 1315 - DNA, 3067 bp, Homo sapiens
gggaccaagagcggaagtgggtgtgacggggacgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggcccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcg

SEQ ID NO: 1316 - DNA, 2856 bp, Homo sapiens
cgcaccacccccttcccgccgcgctctctcccgcccccgcgcttccggccccgcccgcccccgcgcggaggactgtgggagcggcttccttggattccgcgcttggcaacggctcggcgtcgcgctttggccaaccgctgcgtcgtccctgggcccgaataactgtcgcccgcttccctcagcgtgaggtacaaatgatgcaaaatgtgcacctggctccagagacagatgaagatgatctttattccggctataatgactacaatccaatctatgatatcgaggaattggagaatgatgcagcttttcagcaagctgtgaggactagtcatggcagaagacctccaataactgctaaaatatcaagcacggcagttactagacctatagctactggatatgggtccaagacatctctggcatcatcaataggaagaccaatgacaggggctattcaggatggagttactagacccatgacagcagtgagagcagctggttttaccaaagcagctttgagaggctctgcatttgacccccttagtcagtcaaggggccctgcttcccctttggaagccaagaaaaaagatagcccagaggaaaaaataaagcaattagagaaggaagtaaatgagttggtagaagaaagctgtattgccaatagttgtggagacttaaaattggccttagaaaaggcaaaagatgcaggaagaaaagagagagtcctggtgagacagcgagaacaagttacaactccagaaaatatcaatttggatttaacttactcagttcttttcaatttggccagtcagtattcagttaatgaaatgtatgccgaagcacttaacacttatcaagttatagtcaaaaataagatgtttagcaatgcaggaatattgaaaatgaatatgggaaatatctatttaaagcaaagaaattattccaaagccattaaattctaccgaatggcattagaccaagttccaagtgtcaataagcaaatgaggattaaaataatgcagaatattggagttacatttattcaggctggtcagtattcagatgctattaattcatatgagcacataatgagcatggcaccaaatctgaaggcaggctacaacctaactatctgttattttgctattggagaccgagaaaaaatgaagaaggcattccaaaaattgattactgttccattagaaattgatgaagataaatatatttcaccaagtgatgatcctcatactaacttagtaactgaagctataaaaaatgatcacctcaggcaaatggaacgtgaaaggaaagccatggcagaaaaatatattatgacatctgcaaaactcattgctcctgtaattgaaacatcttttgctgcaggttatgattggtgcgtggaagtggtgaaagcttctcaatatgtagagctagccaatgatctggaaataaacaaagcagttacatacttgagacaaaaagactataaccaagctgtagagatcttaaaagtgttggaaaaaaaggacagtagagtgaaaagtgcagctgcaaccaatctctcagccctgtattatatgggaaaggattttgcacaagccagcagctatgcagatatagctgtgaactctgatagatataatccagcagctcttactaataaagggaatacagtttttgcaaatggtgattatgagaaggccgctgaattctataaagaggctctaagaaatgattcttcttgtactgaagcactttataatattggccttacctatgagaaactaaatcggctagatgaggctttggactgtttcctgaaacttcacgcaatcctacgaaacagtgccgaagttctttaccagatagcaaatatatatgaattaatggaaaatcccagtcaagctattgaatggctaatgcaggtggtcagtgttattccaaccgatcctcaagttttatctaagctaggagaattatatgatcgtgaaggagataaatctcaagcatttcaatattactatgagtcatataggtattttccttgtaatattgaagtcattgagtggcttggagcctattacattgacacccaattttgggaaaaagctattcagtactttgaaagagcttctcttatacagcctacacaagtgaaatggcagctgatggtagctagttgtttcagaagaagtggtaactaccaaaaagcattagatacttacaaagatactcacagaaaatttccagaaaatgtcgaatgtctgcgtttcttagttcgtctctgcacagatcttggattaaaagatgctcaagaatatgccagaaaactgaagaggttggaaaaaatgaaagaaataagggaacagcgcataaagtcaggcagagatggcagtgggggctcccgtggcaaaagagaaggaagtgctagcggtgatagtggccagaactatagtgccagtagtaaaggtgaacgactaagtgccagactcagagctttacctgggacaaatgaaccttatgaaagtagcagtaacaaagaaatagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaact

SEQ ID NO: 1317 - DNA, 3516 bp, Homo sapiens
attggtgagtggggcagggcaggagggaactgaagagtgagaaagcattatttcagcaaaaggtctttcctcccttgctctctcctccaaccactggctcagcctctccgcccgctgcctgtgaatgatgcaatggaaggtgtgctggggtcgccctgtgtcccgtgcataggagcatctcagcctccaggtcctctcctttggggctcacggcacccccatgctacgaaccgcaggcagggacggcctctgtcgcctgtccacctacttggaagaactcgaggctgtggaactgaagaagttcaagttatacctggggaccgcgacagagctgggagaaggcaagatcccctggggaagcatggagaaggccggtcccctggaaatggcccagctgctcatcacccacttcgggccagaggaggcctggaggttggctctcagcacctttgagcggataaacaggaaggacctgtgggagagaggacagagagaggacctggtgagggataccccacctggtggcccgtcctcacttgggaaccagtcaacatgccttctggaagtctctcttgtcactccaagaaaagatccccaggaaacctacagggactatgtccgcaggaaattccggctcatggaagaccgcaatgcgcgcctaggggaatgtgtcaacctcagccaccggtacacccggctcctgctggtgaaggagcactcaaaccccatgcaggtccagcagcagcttctggacacaggccggggacacgcgaggaccgtgggacaccaggctagccccatcaagatagagaccctctttgagccagacgaggagcgccccgagccaccgcgcaccgtggtcatgcaaggcgcggcagggataggcaagtccatgctggcacacaaggtgatgctggactgggcggacgggaagctcttccaaggcagatttgattatctcttctacatcaactgcagggagatgaaccagagtgccacggaatgcagcatgcaagacctcatcttcagctgctggcctgagcccagcgcgcctctccaggagctcatccgagttcccgagcgcctccttttcatcatcgacggcttcgatgagctcaagccttctttccacgatcctcagggaccctggtgcctctgctgggaggagaaacggcccacggagctgcttcttaacagcttaattcggaagaagctgctccctgagctatctttgctcatcaccacacggcccacggctttggagaagctccaccgtctgctggagcaccccaggcatgtggagatcctgggcttctctgaggcagaaaggaaggaatacttctacaagtatttccacaatgcagagcaggcgggccaagtcttcaattacgtgagggacaacgagcctctcttcaccatgtgcttcgtccccctggtgtgctgggtggtgtgtacctgcctccagcagcagctggagggtggggggctgttgagacagacgtccaggaccaccactgcagtgtacatgctctacctgctgagtctgatgcaacccaagccgggggccccgcgcctccagcccccacccaaccagagagggttgtgctccttggcggcagatgggctctggaatcagaaaatcctatttgaggagcaggacctccggaagcacggcctagacggggaagacgtctctgccttcctcaacatgaacatcttccagaaggacatcaactgtgagaggtactacagcttcatccacttgagtttccaggaattctttgcagctatgtactatatcctggacgagggggagggcggggcaggcccagaccaggacgtgaccaggctgttgaccgagtacgcgttttctgaaaggagcttcctggcactcaccagccgcttcctgtttggactcctgaacgaggagaccaggagccacctggagaagagtctctgctggaaggtctcgccgcacatcaagatggacctgttgcagtggatccaaagcaaagctcagagcgacggctccaccctgcagcagggctccttggagttcttcagctgcttgtacgagatccaggaggaggagtttatccagcaggccctgagccacttccaggtgatcgtggtcagcaacattgcctccaagatggagcacatggtctcctcgttctgtctgaagcgctgcaggagcgcccaggtgctgcacttgtatggcgccacctacagcgcggacggggaagaccgcgcgaggtgctccgcaggagcgcacacgctgttggtgcagctaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgaggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccagtgcaggctgcagatgattcagttgaggaagtgtcagctggagtccggggcttgtcaggagatggcttctgtgctcggcaccaacccacatctggttgagttggacctgacaggaaatgcactggaggatttgggcctgaggttactatgccagggactgaggcacccagtctgcagactacggactttgtggttgcagctggatagctgtggcctcacagccaaggcttgtgagaatctttacttcaccctggggatcaaccagaccttgaccgacctttacctgaccaacaacgccctaggggacacaggtgtccgactgctttgcaagcggctgagccatcctggctgcaaactccgagtcctctggttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccaggcatggtggcgggcacctgtagtcccagctactcaggaggctgaggcaggagaatcgcttgaacccgggaggtggaggttgcagtgagccgagatcgcgccactgcactccagcctgggcgacagagtgggactccatctc

SEQ ID NO: 1318 - DNA, 7033 bp, Homo sapiens
ctgggcatccacttgacagccggcggcgctcgcggccctcagcatgttccgcgaggcgagggttttcctcccgcctgtgggctgaggcggcggcggcccccgaaacgagatgcacctgacgggcgcggcttagaggacgcggctggcgggaagtcccggcagccagcgggagggctttcgttgccgggccgccgccgcctcccgtcgccgccgcgggcccgagcgggagcggcgggtgggcgccccgacatggcggcccggagcgccccgagctgccacctgcggctcgagtgggtgtacggctaccggggccaccagtgccgcaacaacctctactacactgcggccaaggagatcgtatacttcgtggcgggggtcggcgtggtgtacagcccgcgggagcacaggcagaagttctaccggggccacagcgacgacatcatcagccttgcattgcatcctgaacgagtgttggtagcaacaggacaagttgggaaagagccttatatttgtatttgggattcatacactgtgcagaccatatcagttttaaaggatgttcatacacatggtatagcttgcttggcgtttgacttagatggacagcgcttggtttcagttggacttgattcaaagaatgcagtttgtgtttgggactggaaaaggggaaaaatgttgtctatggctcctggtcatacagatagaatatttgatatttcttgggatttgtaccagccaaataaacttgtcagctgtggtgtaaaacatatcaagttctggagtttatgtggaaatgctctgaccccaaaacgaggtgtctttggtaagacgggtgaccttcagacaatactgtgcctagcctgtgcaagggatgaattaacatattctggtgcactcaatggggatatatatgtttggaaaggaatcaatcttatacgaacaatacaaggagcccatgctgcaggaatttttagcatgaatgcttgtgaagaaggctttgctactggtggcagagatggttgtattcgtctttgggatttaacttttaaaccaattactgtgattgatctcagggaaacagaccagggatacaaaggtttgtctgtaaggagtgtgtgttggcgaggtgaccacattctagttggaacacaggacagtgaaatttttgaaattgtggtgcaagaaagaaataaaccttttctaattatgcaagggcattgtgaaggtgaactttgggcacttgctgtccatcctactaaacctttggctgtgactggaagtgatgatcgttcggtcaggatatggagcctagtagatcatgcattaatagcaaggtgtaatatggaagaaccaattcgttgtgcagctgtcaatgcagatggaatccatcttgcccttggaatgaaggatggctcattcactgtacttagagtaagagatatgacggaagttgtacatattaaagataggaaggaggcaattcatgagttaaaatattcaccagatggaacttaccttgctgttggatgcaatgacagctcggttgatatttatggagttgctcagcgttataaaaaagttggcgagtgtttgggatcccttagtttcatcactcatctggactggtcttcagacagtagatatttgcagacaaatgatggaaatgggaaaagacttttttatagaatgccaggaggaaaggaagtgacaagtacagaagaaataaaaggtgttcattgggcttcatggacatgtgtttcaggccttgaagtaaatggaatttggcccaagtattcagatatcaacgatataaattcagtagatggaaattatattggccaagttttagttacagctgatgactatggaattataaaattattccgatatccatgtttaagaaaaggggccaagtttagaaaatatattggccattcagctcacgtaactaatgtcagatggtcacatgattatcagtgggttatttctattggtggagcagatcactctgtctttcagtggaaatttattcctgaaagaaaactgaaagatgctgttcacatagcaccccaagaaagtctggctgactctcatagtgatgaatcagattcagatctgtctgatgttccagaactggattctgaaattgaacaagagacacagctcacctaccgtcgacaggtttacaaagaagatctacctcagcttaaagaacagtgcaaagagaaacaaaaaagtgctacttctaaaagaagagagcgggctccaggaaatagtattcgattacactttgttcacggttacagaggttatgactgtcgaagtaatctgttttatactcaaattggtgaaattgtgtaccatgtggcagcagtgggtgtcatttataatcgacagcaaaacacacagcgtttttatctgggtcatgatgatgatattctctgcctaactattcatcctttgaaagactacgtggcaacaggccaggttggtagagatccctcaattcatatatgggatacagagaccattaaaccattgtccatattaaagggccaccaccagtatggtgttagtgccgttgatttctcagcggatgggaaacgtttggcatcagttggcatagatgatagccatactgttgtgctctgggactggaagaaaggagagaaactttcaatagcaagaggaagtaaagataagatttttgttgtaaagatgaacccctatgtgcctgataaactaattacagctggaattaaacacatgaaattttggcgtaaagcaggagatgtgtgtatctggagagacatctttcttgtaaaaacagtgaaagcgcatgatgggccagtgttcagtatgcatgcattggaaaaagggtttgtaactggaggaaaagatggtatagtagctctttgggatgactcttttgaaagatgtctcaagacctatgctataaaaagagctgcattggccccaggatctaaaggtcttctcttggaagataatccatctatacgtgccatatcattaggacatggtcatattttagttggcacaaagaatggtgaaatactagaagtggataaaagtggcccaataacacttctggttcagggacacatggaaggagaggtgtggggtttagctacacacccttatctgcccatctgtgctactgtaagcgatgataaaaccttaagaatatgggatctctcacctagtcattgtatgttggctgtccggaagctgaaaaagggtgggaggtgttgctgtttttctcctgatggtaaagctttagccgtaggtctcaacgatggaagcttcttaatggcaaatgcggatactctagaggatcttgtgtcttttcatcacagaaaagatatgatttcagatattcgattttcacctggttctgggaaatatcttgctgtagcatcccatgacagctttatagatatatacaatgtaatgagtagtaaacgagtaggaatatgcaaaggagctaccagttacataacccatattgattgggatattagaggaaagcttttacaggtcaacactggtgctaaggaacaattattctttgaagctcccagagggaaaaaacaaaccatccccagcgtggaggtagaaaaaattgcttgggcatcatggacaagtgtacttggtttatgctgtgaaggaatttggccagtaattggagaagttacagatgtaactgcttcttgcctcaccagtgacaaaatggttctagctaccggggacgatttgggatttgtgaagttatttagatatcctactaaagggaaatttggaaagtttaagaggtatgtggcccatagtacacatgtcacaaatgttcgctggacttatgatgacagcatgttggttaccctaggcggtacagatatgtctttaatggtgtggacaaatgagatggaaggctatcgagaaaaaaggccttgtgatagtgaagaatccgacattgattctgaagaagatgggggctatgacagtgatgttacaagggagaatgaaatcagttacaccatcagagccttatcaacaaatattcgcccaatgttaggaatcaagcctcatttacaacaaaaagaaccctcaattgatgaaaggcctccagtgagcagggccccaccacagccagagaaactccagacaaacaatgtaggcaagaaaaagagacctatagaggaccttgtgttggagctcatttttggttatcgaggcagagactgtaggaataatgttcactatttaaatgatggtgatgatataatttatcacactgcatctgttggaattctgcacaatgttgctacaggttctcagagtttttatcaggaacataatgatgatattctgtgcctcacagtaaaccagcaccccaaatttatcaacatagtggcaactggccaagtagttttgagctgttctttgttaactacagctccttctattcacatctgggatgcaatgaacaagcagactttatctatcctaagatgctaccattcaaagggagtatgttcagtcagcttcagtgctactggcaaactattgctgtctgtgggactagacccagaacatactattaccatttggagatggcaggaaggtgccaaaattgccagcagagctggtcacaatcaacgtatttttgtggcagaattccgaccagattcagatacccagtttgtctcagtgggagtaaaacatgtgaagttctggaccctggcaggaagagctcttcttagcaaaaaagggctactgagcacactggaagatgcccggatgcagaccatgctcgctattgcatttggtgcaaataacttgacgtttacaggtaccatcagtggtgatgtctgtgtgtggaaagatcacatattgtgtagaatcgtggcgagagctcacaacgggcctgtgtttgccatgtacaccaccctgcgagatggacttatcgtgactgggggaaaggaaaggccgtcaaaagaaggaggagcggttaaactgtgggatcaggaactgaggcggtgccgtgccttcaggcttgagacaggacaagccacagattgtgttcgttctgtgtgcagaggcaaaggcaagatccttgttgggacaaggaatgctgaaataatcgaagttggagagaaaaatgcagcttgtaatattttagttaacggtcatgtggatgggccaatctggggactagcaacacatccttccagggattttttcctttctgctgcagaagatgggacagtgagactttgggatattgctgataaaaagatgttaaacaaagtgaatttgggacatgctgctcgtactgtgtgttacagccctgaaggggacatggtggctattggaatgaaaaatggagaatttatcattttactagtgagttctctaaaaatatggggaaagaagagagacaggagatgtgcaatccatgatatcagatttagtccggattcccggtatctggcagtaggttctagtgagaactcagtggatttttatgacctaacgctgggccccactcttaacagaatcagctactgcaaagacattccaagctttgtcattcaaatggacttctctgcagatagcagttatctccaggtctctagtggctgctataaacggcatgtctatgaagtgccttcaggaaaacatcttatggatcatgccgctattgacagaattacttgggctacatggactagtattctaggagatgaggttttgggaatctggtccagacatgctgagaaagctgatgtcaactgtgcctgtgtatctcattcaggaatcagtcttgttacaggagatgactttggcatggttaagttatttgacttcccatgtccagaaaaatttgcaaaacacaaaaggttcttgggtcattcgccccatgtgacaaatattcgatttaccagtggtgatcgacatgttgttagtgctggaggtgatgactgcagcttatttgtctggaaatgtgtacatacacctcactgagagatgctgagatgactacagaaattaactttgagaccagaattacagagaagaaaaaccaaaacccaaccctgcatggtcaagtggtgctaacccaagactgtaacagggagaaatgcccagaatcatcaaaatagtgaaagactgatctgttcaaaatatttgctatatgcactgggtataatccgtaatccatacactgccagataatgccatttcaaggaaggatcgaatacttgatggtaaaggccaagtccccctgtattgggaagtgtgtgatttcggcagacctgctgggaaaatttagggtagagcactctttacagaagaactcaaaaacccaatttggataattttcattatctttttagcaaaatggtttcttaatgtttatattttattttcaaggttcattgtttaatgaaatattttattcttgcatttccataaggaaagggaaagtcatgatcatcctaaaggatcacagtttttaaaaggcaaacattttccctaaggaaacagacacaagctttcctagagaatatgatgttttttaggcattaataaggtccttttttataaaggacacttttctcctagtagttttgaattcaggaacagatccaaagttagcagtatatggctgctacatttccattttcattttcgagccatcagtttatgttcagatgccatctctgtaatcgcacatttaaaacataactgtagcctcactaatggaaaagtagtatgatgaacaatcattcccaatggtgtacaatgtaagggttttagggagcaacagtatttaactggaagaaagaattgcatatttaatgtagtctaatatatacacatttgtttaacatgtaaacaaaagtgttaaattcacatatacaacattatacaatttaatcactcttggaataaaatttttatagccttttttctattgggaaaatttgtttagatgtgtgccactccatag

SEQ ID NO: 1319 - DNA, 604 bp, Homo sapiens
aattgcctctcaccccccggaggggttattttgggggtggttggaggcggtggcggcggcggcgaggaggggaatttccttgtgcctccattcccgggaggggggagcggcgttggaggccaccgtttccagggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaa

SEQ ID NO: 1320 - DNA, 2143 bp, Homo sapiens
gttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatgggtgcgacagttgggaagaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcag

SEQ ID NO: 1321 - DNA, 1686 bp, Homo sapiens
attgctctaaaaggcctctgtgccctgactgatcctccctccctgtcaactcctaatctttttattgtctccatagttttgccttttccagaatgttgtaatcatacagtatgtagtctttttgaattggcttctttcacttagcaatgtgcatttaagtttcctaagctgttgatcatgagactgagtccctttttatacttcaacagacatgagaacggcctcaaggaagactaaccatctgcaatactagaagccatggctgagggatcagtgatgttcagtgatgtgtccatagacttctctcaggaggagtgggactgcctggaccctgttcagagggacttatacagagatgtgatgttggagaactacggcaatctggtttcaatgggactttacactcctaagcctcaagtgatctccttattggaacaagggaaagagccctggatggttggcagagagcttacaagaggcctgtgttcagatctggaatcgatgtgtgaaaccaagttattatctctaaagaaggaagtttatgaaatagaattatgccagagggagataatgggacttacaaagcatggccttgagtactccagttttggagatgttttggaatatagaagccaccttgcaaaacaactgggatatccaaatgggcattttagtcaagaaatattcactcctgaatacatgcccacatttattcaacagacattccttactctccatcaaataattaataatgaagacagaccctatgaatgtaagaaatgtggaaaggcctttagtcagaactcacaatttattcaacatcagagaattcatattggtgaaaaatcttatgaatgtaaagagtgtgggaaattctttagttgtggttcacatgttactcggcatctgaaaattcatactggcgaaaaaccctttgaatgtaaggaatgtggaaaggccttcagttgtagctcatacctttctcaacatcagagaatccataccggtaagaaaccctatgaatgtaaggaatgtgggaaggcctttagttattgctcaaatcttattgaccatcagcgaattcacactggtgaaaaaccttatgaatgtaaagtatgtgggaaagcctttactaagagctcacaactttttcagcatgcacgaattcatacaggtgagaaaccctatgaatgtaaggaatgtggcaaagcctttacccagagctcaaagcttgttcaacatcagagaattcatactggtgagaaaccctatgagtgcaaggaatgtggcaaagcctttagtagtggctcagcacttactaatcatcagagaattcacactggtgagaaaccctatgattgtaaggaatgtggaaaggcttttactcagagctcacagcttcgtcaacatcagagaattcacgctggtgagaaaccctttgaatgtcttgaatgtgggaaggcctttactcagaactcacaacttttccagcatcagagaattcatacagatgaaaaaccatatgaatgtaatgaatgtggaaaggcctttaataaatgctcaaaccttactcgacatctgagaattcacactggtgaaaagccctataactgtaaggaatgtgggaaggcttttagtagtggctcggatctcattcgtcatcagggaattcatactaataaataa

SEQ ID NO: 1322 - DNA, 2498 bp, Homo sapiens
attcacggcacccctgatagcgaggtcggcgtcacggtgtaggcgcgcagttggggaaaccgaggcccaacgtgggcggcagctaccagagatggcacacggaggactcaaattcgtccattcagtcattcgttcattcattccttcgggaaaccttgcagatctcccaatctgggcaactctgagctgggcgccagtagtctgggggtgctgacgggaggaggggccagagttttcaaagacgattaaccgaggctcacgtcgcggagccaacctagaagttctctggggacagaaccttggcggacaactgaattaattgttctagtctccaggcccagtacatggatgcttgttggatgaattaatgaaccttgacccacaccaagattctgagaatttggtttctgtcaagatgtgcctctccagccaggcctctcctgccaggacggtggccacagggccatctccctctcctggcgcccccaactgcctggccaaggtgactgctacacacgtggggtcgcagaatccctcgagtcacaacgtcttcaacgtcttgtcagtcccgtgatcgcactaaacgtatttaaagccccctactcctttaagagggtcacctctgtgtacaggcggcctcctcgtactaagtgtggtggcgttcaaggctccgagacacaggcgcctcccgcgccactccccgggcacaggaactcctactcatccctcagtcatcagctcgaaggtttcttctccaagaagcctgcccggcactcgagaagtagagccgcgagccttctcccgggggcccagccttccccagtaccggcagggatcaccccgggagcacgcgcccggccccgctgaggccaggggctcctcggaggcgcgggaaagccggggaaccagcgcagttacggcacacacgaggcggggcctgcacagatgccgggcgcccgatcctcagtgacaaaatagagactccgtggaagggacactgaggtgggggaggctgcggtgatcccataccgcactccaggtgccaggctccgccccgcccctgacggcgcttccggatccggcgggtgccggaagtgggcgggcggcggcggctgcgcgcggaggcggtggaggaggtgctgggagcagccgggcagccgcttcccgcccccgagcaggagccggtgcgagcggagcagagccgaggtcgggccgcgagcggagccggctgagcgggcgccgagctcccgccatggcccggaacacgctgtcctcgcgcttccgccgggtggacatcgacgaatttgacgagaacaaatttgtggacgagcaggaggaggcggcggcggcggcggcggagccaggcccggacccgagcgaggtggacgggctcctgcggcaaggggacatgcttcgggcattccatgcagccttgcggaactctcccgtcaacaccaagaatcaagctgtgaaggagcgagcccagggcgtggtgctgaaagtgctcacaaacttcaagagcagtgagattgagcaggctgtgcagtcactggacagaaacggcgttgacttgttaatgaagtacatttataaaggctttgagaagcccacagaaaatagcagcgcagtgttactccagtggcacgaaaaggccttagcagtaggaggactaggctccattataagagttcttacagcaagaaagactgtttaaaaaaaataaaaagactcatgttaccttgagaagaattctggatgcccaggctggtgaagaagggattgacaatggaccatcttcctaggaactcccaagtaaactatttcaggacatgtatctgctgaaatgtattttattttcaaggtggaggggaaaatcgtctgtttcctaaatcctgtttaggatctgatagtctatgcctttgtctccgagtactgcagaactgacattttgacggtctaccagcgtggcggctggtgttggtcagatgcacctgtgtgcactgggggagggatggtttgggcaggtgcagatccaagggctgtggtaaacgggagagcttgtgtttttgaagtggaaaaaaacccaagagtttgtacagacatcctgtcttcccagagaaggtggacactcttgggctcattgtaaagtgcctgctgcatcaataaagctcttggcttattagtctatacattgcggtgtgtttcgtgtatgtaaaaaaaaatggtaatgaatgggatggtaatgaatgagagttcagttgttgttccggaaacccgatgtggaaggagtagacctgtgtccctgttgagccacccctgggagcgagcatggcaatccacaggccctctgccacaggacgccagcctcggcctcagagctgccggctgctgcagagaggtgtttgctgaataaactatttattgtttcttattcctttgatttgtatgtaattaattttggagcttatttaattaatttaataaagtgccaaacattt

SEQ ID NO: 1323 - DNA, 7164 bp, Homo sapiens
gacgcggccggcggggcggacgggagcgggccgcgcgtggcggcggcgatgggcgagggcgggctgcccccggccttccagctgctgctgcgcgcgtgtgaccagggcgacacggagacggcgcggcggctgctggagccgggggcggcggagccagccgagcgcggcgcggagccggaggcgggcgcggagccggcgggggccgaggtggccgggcccggggccgcagcggcgggggcagtcggggctccggtgcccgtggattgctcggacgaggcgggcaacaccgcactgcagttcgccgcggccgggggccacgaaccgctggtgcgcttcctgctgcgccgcggtgcctcggtcaacagccgcaaccactacggctggagcgcgctcatgcaggcggccagatttgggcatgtgagtgtggcacacctcctgttggatcacggggctgatgtcaatgcccagaaccggctgggggccagtgtgctcactgtggcttctcggggcggccacctgggtgtggtgaagctgctcctggaagccggtgcctttgtggaccatcaccacccttcaggcgagcaactggggttgggcggcagcagggatgagcccttggacatcacagccctgatggctgccatccagcacgggcacgaggccgtggtgcgtctactgatggagtggggcgcggaccccaaccacgcagcccggaccgtgggctggagcccgctgatgctggccgcactcactgggcggcttggagtggcccagcagctggtggagaagggcgccaaccctgaccacctcagcgtgctggagaagaccgccttcgaggttgcactggactgcaagcacagggaccttgtagactacctggacccgctgaccaccgtcaggcccaaaacagatgaggagaaaaggcgacctgatattttccatgcattgaaaatgggaaacttccagctggtcaaagagattgccgatgaagaccccagccacgtgaacttggtcaatggggacggggcgacgccactgatgctagcagctgttacggggcagctggctctggtgcagctgctggtggagaggcacgcggatgttgacaagcaggacagcgtgcatggctggacggccctcatgcaggcaacctaccatgggaataaggaaattgtgaaatatctgctaaaccaaggggccgatgtcactcttcgtgcaaaaaatggatacacggcctttgacctggtgatgctgctgaatgatcccgacacggaacttgttcgactgctggcatctgtctgcatgcaggtgaataaagacaaaggccggccgagccaccagcctcccctgccccactcgaaggtccgacagccctggagcatcccagtgctgcccgatgacaagggtggactgaagtcctggtggaaccgaatgtccaatcggttccgaaagctcaaactgatgcagacgctgccccgtgggctgtccagcaaccagcctttgcctttctctgacgagcctgagccagctctggactccacaatgagggctgccccccaggacaagacaagccgctctgcactccctgatgcggcccctgtgaccaaagacaatggtcctgggagcacaagaggagaaaaggaagacacgttattgacaaccatgcttcgaaacggagctcccctcaccagactcccgagtgacaagctgaaagcagtcatccccccattcctacccccttccagttttgagctgtggagctctgatcggtcccggacgcgtcacaacgggaaggcagaccccatgaagactgcgctgccccagagagccagcaggggccaccccgtgggcggcgggggcacagacactacacccgtcaggcctgttaaatttccaagcctccccagaagcccagcctcttctgccaattctggaaacttcaaccactcgcctcattcatcgggcggctccagtggggtaggtgtgagccggcacggtggggagctgcttaaccgctcaggtggcagcatagacaatgtcttgtcccaaatcgctgcccagaggaaaaaagcagccggattattggagcagaaacccagccatcggtcaagccctgtggggccagcaccggggtccagcccgtctgagcttccagcctcccctgcaggtggcagcgctcctgttggcaagaaattggagaccagcaaaaggcctccatctggaacttccactacctccaagagcacctctccaaccctcacgccctccccctcacccaaagggcacactgcagagtcctcagtgtcttcctcgtcatcccatcggcagtccaagagcagtgggggctccagcagtggcaccatcacagatgaggatgaactgactggaatccttaagaaattatcacttgagaaatatcagcccatttttgaggaacaagaggtggacatggaagcgttcctcacactgactgacggtgacttgaaggagctgggaattaagacagatgggtccaggcagcagattctggcagcgatttctgaactgaacgcaggcaagggacgcgagagacaaattttacaggaaaccattcacaactttcactcttcctttgagagcagtgccagcaacaccagggcccctggcaacagcccctgtgcgtgatcctccttcccgcagccaccagcgtgagctctctgaatcccgggaccccttcacgtggccacagccccagccctgcccccgtcacactgctgtgccttagtcatgttgttccctttgctcgggatgcccacttcacgtcgacggcattcattggtagtacttcttgctgcaacaaacttcaacacacagagacagattcccatgtaacagtccagtgggggtgcttctgcttggcaggttggttcacacagtgatgcagggactcagctcctttcatcctgtgctctgccctccccgggagcctcagagtttgcttctggctggcggcaagggaaagggacgatggagaaggcacggctgcttcttacctgccttgctcttaactgacacacatcactcctgctcacgtcctcttggccactggtagtcatgtggccccacctggatgcagaggaggccaggatgtgcagtctccacatagtggcttcccagcaacaacttttgacttagatggggggtatgtattatggtgagaggttagccttcctggcacatcttcccttaaaacttctaacttgcccctcctagtccaagtcacctctcagatgaagtcttttttgaccccctttcagccactgggtcccttagtgctgtgtatgtgactgctgtagcattccactgcacctgctgcatacagcttacattggagatgtgtatgtcaaacgcatttttctttattgcaaagagagtctattatagaaggaaagaagtggaggcctgctgtgtggatcccttcttcttcctagctttcagtttccttatctgcaaagtggaaggtcagaccagatgatgctctggtactccacagtgctcacctgtatcactgcagggctttctgcactgaaagtggaagcagaaggctaatgggtcacattgtgtaaaggtctctggtgctcaaagtttctaggcaaagaagtgaaaatttggaattttgtctacatcctattaatgctgtgttcctcaaaagggaattggcttgtgtagtttcctaccatatcatattttattaaattagaggggccctgacttttaaaacccactggctttctgaagtgttttccagtgaatgactcattcagccagtgcttgttgcatttatgttagctaccaggtgccaagtgtgcagacacaatacagagccttcaggctctcgacaggcaagagaacacctgtaaatagatggtcccgacattgagaggcagcatggtagagtgggcagaccttgtgctctggactcaggttcaaagttcagatgaagctcaatggcctcttagttggagcttagaaccagtatgcccaaagtgctgggtctgcaggaagtacccagtcgatggtaggctgcacagaattctgatctctaccttgagccatgctgagccacaagttggtctccttgggaggtgccatctctcatctgtccctcccccagccatgaaagcccattcccctatgctggctttcagaggctgtcgttaacttactgcccagagcctcgtagttttcttcccctgccctgatggttgggtgtttttcctttaaattctctcagccttacactcacagaagccaactttccacaggactgaagacaaagtgtttcatttagctgttactgatagacacctttacaaaggttactaatgtcccagcctttttaaggagacacactcattcatcccctactatgtgctggcagctttacctttgtcatttcatcctcatggccaccctggaggtggcattgtgtaacctcatcttgcacattcgggaaacggatgcttaggagagggaagcagcttgccagttaaacagcccagaaggagcagatctggggtcagaaccggacctggtgggcttgcaagcctgtgccttttccactaactcctatagactcctggagctagaagcacttgtgattcttgttttaatttactgatggcttcaggggttaacagtaggcctagaattgtttgcctctgaaattcatggcccctgacgttatgtgctttgaggttttgtgcctgctttttgctgtggtcctgtttttttcataacaatatactggtatagcttccactcaggtaagtttgattgaacaatgatacacagctgcaccggggggtcaccttttcacaaatgtagacctccatgaactcattggatgaccctggacagagcggggctattcccattttgcagacaggacagcagaggctccagacaatgcctttcctttctttttcactggactcaagtgtccaaggcttttcatcctaggaagtttgtgtgctggttcacaagaggtccctggcaccctttctggggatgtttggatgcggctggtaggcagggaagagaaagggcaccccagcgggggcatgtgtggaggcagcacggaacatgtaggttatagatcgtcagggaggaggggtcagttgggtgcttgtttttctgatttttggtccttgatcacccccttcccttcccacacgtgtccccagcctgcctgtggctgttccccccacaagaagcacctcccttgcttggcaaccttcaccagcatttcccaaaagtatgctcctgggaaccctagttccacaggataataggtttttcataaagaaacgtagggtgtgtatgtgaaagtggggtgaggttccctggttgagtaggtttggcagacactaaagcgagctacacgatcatctttgctacaggcctctcacaaccttcagcatgccagcatgggtcaggcctcttcacagggccaagaaactcatagcatctcccacattactctcatcacttctccaaggtgcttttgcaagactggaattccttggacaccattggagaagccccgctttttctggaacagcggcaaccaagaggccttgcagccctggaagtgggtcagggcccttggtggtcacctttttctccccagcagctctgcagaggtggcctgcttggcagtgggacatcaggggaccggtcctgctttgagatggcagggtccctgttctgagagctctccagcctgagggcattgagctgaggctccaccctgagctctcctgcagggtggagggcattgtttcccagcacccaggcagtgtcttgctggtgtgtcgtgagtgctggatgtccaagtccctgctggccacggagggctcctgcctctcttcttcagcgccacaaaattacatggaggccagctggttttgtgaggagattgtttattttttaattcttttgtttaccgaacgtttactgagcatctaccctgtgccagccctactcgtacgctctgtctccaaagatgaaaaaggacttctctgccctcaagggaaccccacagtatcttagaggagacaatcatgtcggtgagatggtgtggtgatgaagcctgctgggtatacagctcagggaaagtcatcgatgatggctcaggctcagcctgggcacgccccagaggagagagatggagtggggcctcaaagggcaggtttaggcagaaaagaaaaagggcattccagctggggcatgtgcaaaggcagcacgtaatgtgtaagttctagatcgtcagggaggaagggtcagttgggtgcctgtttttctgtttttagtcctttaaaatgagtagaagcaacctgttaccctggaaagagcactggacatagacctagtgctgcgtgatgttgagcacgtttcttcttccctttgagtcccagtttcccttttggttacagggggatagtagcccccagggatcatgtgaaagtgagaaagcccttttcacactgtggagcggtgcagatgtgggaaacctcaaagatggttgcccattttaaatcctttcatctctcatctctctttcttctctcccttctgccctgacgtagccatggttgggtgggtgaggccagaagaaactgcctccggcaagaggtagcagccgctcaggtggctctgctggcatcggagcccacagaagtgaggagtggccgatggacctgccctccaaatgtgcctgactctgggtcttgctgtcactggatttcctggcatggcagacagaaagaaagatagtttgaccaagtcgtagaagctgatccagcgggtaaaaagggggcagggaactcgtcccttttattcttgcctcagagctgcctgaagacatgggccaggccggaggctggacaactttggataacgctgacctgtacttccaagtaaatgcctcctgaagagcccgggacccttcctgggagaattctgcagccagaatgaaggtgccatcagcaggaggcactgtgaagcaccatcctgtcgctgtccttgtccattcctagcaagttaatcgtgtcttgttaaccagcagttcctgttcaacgtgtaaagagacctgatgttttccctaataaagctgataacaga

SEQ ID NO: 1324 - DNA, 2624 bp, Homo sapiens
tttgttgttgacaactgtcagcttcgacctccttctcctcacaaccccgtctaaatggggtttgtaatcctccttcccacccactctcttcactccctggggcaagaatgttgactcctgctctccgtcacctgtcaggatccatcctcctgtcactggcttatatggacacgtcagcccaccgtcacgtgaccgcaggctgctaaaaacagctccagcacccactccaaaccagggcctgaaacaatgtcctccaccgagagaaacgtaaaggacacttgatcacacaatccctggaataatatccaggaaacacttgctggagccactcgcagcacccttccctggcagcacacttggggacagcgaggagatgagcgcatctctgaattacaaatctttttccaaagagcagcagaccatggataacttagagaagcaactcatctgtcccatctgcttagagatgttcacgaaacctgtggtgattctcccttgtcagcacaacctgtgtaggaaatgtgccagtgatattttccaggcctctaacccgtatttgcccacaagaggaggtaccaccatggcatcagggggccgattccgctgcccatcctgtagacatgaagtggttttggatagacatggggtatatggacttcagaggaacctgctggtggaaaatatcattgacatctacaagcaggagtccaccaggccagaaaagaaatccgaccagcccatgtgcgaggaacatgaagaggagcgcatcaacatctactgtctgaactgcgaagtacccacctgctctctgtgcaaggtgtttggtgcacacaaagactgccaggtggctcccctcactcatgtgttccagagacagaagtctgagctcagtgatggcatcgccatcctcgtgggcagcaacgatcgagtccagggagtgatcagccagctggaagacacctgcaaaactatcgaggaatgttgcagaaaacagaaacaagagctttgtgagaagtttgattacctgtatggcattttggaggagaggaagaatgaaatgacccaagtcattacccgaacccaagaggagaaactggaacatgtccgtgctctgatcaaaaagtattctgatcatttggagaacgtctcaaagttggttgagtcaggaattcagtttatggatgagccagaaatggcagtgtttctgcagaatgccaaaaccctgctaaaaaaaatctcggaagcatcaaaggcatttcagatggagaaaatagaacatggctatgagaacatgaaccacttcacagtcaacctcaatagagaagaaaagataatacgtgaaattgacttttacagagaagatgaagatgaagaagaagaagaaggcggagaaggagaaaaagaaggagaaggagaagtgggaggagaagcagtagaagtggaagaggtagaaaatgttcaaacagagtttccaggagaagatgaaaacccagaaaaagcttcagagctctctcaggtggagctgcaggctgcccctggggcacttccagtttcctctccagagccacctccagccctgccacctgctgcggatgcccctgtgacacagattggatttgaggctcctcccctccagggacaggctgcagctccagcgagtggcagtggagctgattctgagccagctcgccatatcttctccttttcctggttgaactccctaaatgaatgatattcattccaactgctgcccctctgtctgcctggctgagatgcatgtgggcagcaggaagcccaagtgaaattaatattatgcagatgatgaaagggacctctgaacaggatttctgcaaaaatagccccaaactgcaattccatatgacttatctaacatcttggggggaaagaatattttgagaaaatagttgcagaaagcactggaaataataaacttgatcttatacaaatcttctattgtgtggaaaatgttgtgaagggtgtgtaggtgtggtacatgtgtatgtcactaacaagtggcaaatggtgaaaaaagtggtcactatgcttttgtctctcataggcactgactttttgttattatattatggtagctttcatttcctttactctttaacagtgcaggtggtcagtgaaaatcagtgtcaactcagaagtgactgatttatcaatacatggacaaaaagtaaatcattgaccaaagctatgaaatgtttcacaaagttttcctcttttgcataacagatgtcactggatgtacattcagaaatgttctttgaatttggtgacactttcatggtccagaaagctgaaggcctgggcatctcttgtgacatttttctaatattagttttagattttcacgtattaggcactttagttgaatcttccagcaaaagctgtctactttctcttttattcactgtggcaccaatctggtaaattgtagaacaattgcatgtgtttaaatatatatacaaacatatcacacattaaatatatatatatttaaatcatgctttgttaatatttgtcccaccataatgcctccttcagaacataagtgtaactttatatgaactcttaaataaatgatgtttttaaaa

SEQ ID NO: 1325 - DNA, 2018 bp, Homo sapiens
agcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccagaaagcatccatcatgaatgcaagatactttcaataaaaagtaagttatatagtaggtagttaagtttgcttttgtggacttaaatgtgtctcttcacttaaatgggttgaatgtgtatatatttgttcagcttgaaaagacttagtttatatcctagctcactggaggctgctgacataaccataacttctgtcccttctaattgtcatttatatgcctaactggagctagtactttaattcttaacacaaaattactctgccattgtttccagcttccctcctacaatagaatgaagtttttttgatggcttgagatggctcacaaattttgatttttttttcttccttgtgctccctttttttctccttgcttttccagttaacatctatattcacatgtaatcttgttttctcttcacattcactgagttgttcaggctcagatcatcccttgacagtagtttgccttcatctcacctttcatttgtcccaaattcaccttatttaataaagtcccatatgttgtctcacttaa

SEQ ID NO: 1326 - DNA, 3742 bp, Homo sapiens
ggccgtgcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggttttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatg

SEQ ID NO: 1327 - DNA, 3091 bp, Homo sapiens
acttccggcttcgctgctcttggttctggttctggaggctgggttgagaggtcgccggtccgactgtcctcggcggttggtcagtgtgaatttgtgacagctgcagttgctccccgcccccgagcagccgaggtgcgtgggggaaggggaagaaggaaaaggtccgggtcgcgtttccgctcagtttttgccagggttgaggcgattccagagagcggcggaaaggataagcctcgacttagaagctaccgagttaccctaagaaaggagtctaccatggctcaagaatctcccaaaaattcagcagcagaaattccagtgactagtaatggagaagttgatgactctcgtgaacatagctttaatagggatttgaagcattcattaccatctggacttggtctctcagaaacccaaattacatctcatggctttgacaataccaaagagggtgttattgaagcaggagcatttcaaggttccccagcaccgccactgccatctgttatgtctcctagcagggttgcagctagtcgactggctcagcaaggaagtgatttaattgttcctgcaggtggccagagaacacagacaaaaagtggaccagttattctagcagatgaaattaaaaatcctgcaatggaaaagttagaacttgttagaaaatggagtctaaacacctataagtgtactcgacagattatctctgagaagctaggccgtggctcaagaactgtggaccttgaacttgaagctcagattgatatattaagggataacaagaaaaaatatgaaaatattttaaaactggctcaaacattgtcgacccagcttttccagatggtacatacccaaaggcaacttggagatgcatttgctgacctgagtttgaagtcactagaacttcatgaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgaagaacagtaaaatcacagcggaaaataaaaagaaagtcgcgttgttatatttctaaaccaacctaacaagaattaagcagagttgggggaagtgggaggggtgacaagcattatagtgattcttgcacaaacagctttaatttttccctttttcatactttaacaattgaactgttaagggtggttttaatgtaaacatagtttctataatctgaacacaataattttcctttttgagaaatccttttgtattgtgagggttgatggctatttctgtagtttgaaaacatctaatagagatttgcactgacaagataaaaattcaaggtttttggtcctggaaatgagggccgattgtaacttttccaaagggaggtttacatgatttgtatcaacatcagatattttatatgtgaatatattaaacatctttaagagattcattttcatgtattaaagaaaaaagaaactattttgcagagtaaagttatatggtgttcctgcagcgtccacacagaggcagcagctctaatgaatgattagcttgtggagttgtggcaaatacctttttaaaaatgaatctgtaccactgtaattttatttagacttttttttaaagacacagaaatcacactgtcatttctgtgaggcttttaagcttatgaatttgcttcacccgaagtcattggacagttacatttgcaatttcttttggttcataacaaaacctgcttaagagaatttttttttttgacaggtggacgtgggaatggaaattcttaatggtttctggagtagaaatctgtacttagaaaactagtttttgggtcagttccattttgatagaagtgaatacatagacagcttttattgacttccatatgtaacaataccgtttaagccttaaatcacagatatgtgccttctcagatacagtaattcttgttcaaccaatgtacaaaatccataaagaaacccctgttggataatgtttgatgtgtctattccttccatggaatggagcactatgtatgaatgttgggtttctttgtacttgttaagccacatttgaggtttatggtaaaaatcatcttttgagtttgctctttggtttttcttcattccttttgaggattgggaaaacagaaagattctttgatttgggtaatgaagaggtaatttgggacagtgtggtggtaccaggaagaaagaggattggaaaggccagtactgttttagttgctcggcactgttggttttgttttaatgtggttgccctgtccactacatggttctatcagtagtgtaatccattttcaatgtaaagctcttttagtttttgtcatagacataaattaatattttgagaggcatccctcacctgttcatttcttctgtgttgaaatgaagtacttaaaattaccgttatacatgaactttgtggactgtaagatttgttatatatgttcaaatgccttttagctggctttttaattaatatgcctgttttgagtgcttaatacaatgtaatgtgattgtaaatcatacctattttaaatcattccttcctgtatatttgtactcagagagccttattttattcttccagcagaattactacttgtgatagttcatttacattccccagaatgtgcctctagtgtgaattttgtattcttattaaacgtgtttgctgcagtaaa

SEQ ID NO: 1328 - DNA, 5176 bp, Homo sapiens
tgggataaacggagctggacgactcagtctcttggtctgtggctgctgcggttacctggatgggcgagcacctctgaggctggctttgttacctgggcaataagggactagcagttcagccgttttctatgcctgctggatttgtttgtatttgttcccagccactgctcatgtaatgtactcccttaaccaggaaattaaagcattctcccggaataatctcaggaagcaatgcaccagggtgacaacgctaactggaaagaaaattatagaaacatggaaagatgccagaattcatgttgtggaagaagtagagccgagcagtgggggtggttgtggttatgtgcaggaccttagctcggacctgcaagttggcgttattaagccatggttgctcctagggtcacaagatgctgctcatgatttggatacactgaaaaagaataaggtgactcatattcttaatgttgcatatggagttgaaaatgctttcctcagtgactttacatataagagcatttctatattggatctgcctgaaaccaacatcctgtcttattttccagaatgttttgaatttattgaagaagcaaaaagaaaagatggagtggttcttgttcattgtaatgcaggcgtttccagggctgctgcaattgtaataggtttcctgatgaattctgaacaaacctcatttaccagtgctttttctttggtgaaaaatgcaagaccttccatatgtccaaattctggcttcatggagcagcttcgtacatatcaagagggcaaagaaagcaataagtgtgacagaatacaggagaacagttcatgagttgcattgtagcagacaatggacaactgtagtttctgaattgacttctatagccatcttttcccttttttggagagtagactagcaaaactcccttttttctcttgccttttttatgcataaatggaggtcaatttgattgtcctgacctactgtataagtaaatttcaaatgtcattactttctctttgttattataatgtgtgattaaatgcttttttaaattgctaagggaaaataacaaagtgttagtaatcattgctttctgtagaagaaaaaggtttaaatttaaaatgtgtatttagagcatggagagaatcatttaatgaagcctatttttctgttccagcaactgtttttatgaaagaaaaacttgaaatgctacttaacttactatttcaaagggaagtatatttctttttaaagaatctttttaagattaaaaatgaataccttaaatctcccaaaagagataaccagtatctgaaggtttatacaatatttacacagtggctacaatattcacaaaattcttatgttctcttatgaaaaatatacacttttcattttgtcttcttctttttttttctttttttagatggagtttggctcttgtcacccaggctggagtgcaatggcgcaatctcagctcactgcaacctctgcctcccgggttcaagcgattctcctgccccagcctcccatatagctgggattataggtgcctgccaccatgcccagctaatttttgtgtttttagtagagatggagtctcaccacataggccaggcagtctcgaactcctgacctcaggtgatccacccaccttggcctctctaaatactgggattacaggcgtgagccactgcatccgacctcattttgtttttttcaattctgttatcggcatttctttctttttttttttaatgtataggtgttctgtcatacgttattgtgagctttggttctttgaacaggtgatctattctcttacattttgtgctttttatcttgggtgcctagcattctgtttttttgatcctatgtcataattttttgagaaaatgtttgatactgcaagatcattgtttagtggtctgttttctacttcagtattctaccagagaacatattttttaggggagaagggttatggttttgtaagaaactttaaatatacttttaggagacccacaatcatttacagttttatctttggcctttgaataggttcttttttctttaatgtctccgtatttgaagaactgagctctgtacattataaatttgcttaaagattttgattttttcttcagaatatggtatacttaaaattaattaattaagacagtttcttttttcttttcttttttttttttttcgagacagggtcttgctctgtcacctaggctagagtggagtggcatgaacacaacgcactgcagcctctacctcctgggctcaagcagtcctcccacctcagtctcctgagtagctgagactacagctgtgcgccaccacatctggctaattttatttttatttttgtagagacaggagtcttgccatgttgcccaggctgatctcaaactcctaggcttaagtgatcctcccgccttagcctcccaagtgctaggattacaggcatcagccaccacgcctggcctgatagtttccacatagtttttcatgacttagaagatatcattgccatgtaggttttatttttaaaagtcttgagctcttcttaaatatacattataaagagcaagcatagatggaaagtgcatattgaacacatctgtgcatttgagaaggcaggctttcatatgctgtcatgagcaaaaagtagaagtgataaatgcaagttatgttttgagattgcttacaccgtgacaagatgccatcacttgtgatgttatgaactgttataaactctttgcttctgctaagaagcagtctaaatataatcaacgtacagtgagctctttgaagccaaccaaggcaggcagaaccctcttaaatatgagactgatgtataggttctctctatggtcagtatcactggataagccttctcctttcataagaaaggatgtatttaaatacattttattttgctaaatcctgtttagttttcagccattaaatgtcacatgaagccttgatagaatttgttcataatggctcatgtattattattatttttgagatggagttttgctcttaatgatattattattatttgagacagagttttgctcttattgcccaggctggagtgcagtggcgtgatcttggctcactgcaacctctgcctcccagcttcaagcgattctcctgtatcagcctcccaagtagctgggattataggcatgtgccaccatgcccagcaaattttgtatttttttttggtagagacagggttcaaccatgttggtcaggctggtctcgaactcctgaccgcaagtgatccacacgccttggtctcccaaagtgctgggattacggtgttagccactacacctggcctggattgtgtattatttatgtctgtagtttatatgcttagttgttgcctatagtgatctgggtaagattcaaacatttatcttttgtatcttctacagaagtgctttgagcatcaaatttgttttaacgttaaattgtagtttgctgtattaaaatagatcaatgaatataattcagtcttttaggggcaccaagtaaagcataaggtcatatatactatacaatatgtttattgcacttcccatggggataaatcactctgtcattcctagttattttaaaaaaagaactttatgattacggtcctctttctcacatactgcaaacttaaaagatacatacaccaaatataggtctgttttaaaggagaggaaaaatagttcaaggagtttttgcctctttgtttttcaatagattattctgccattttttaaaggaaagggaaaatgaaaacagcatgtctttttaaacattgaaaagaaatatggaggctttaaaccgcaaactgaaaaagctgagtagaacaaaggcagtggagcatacaatacaattctatttatttgaggttaattgaagttaataatttttaaatttttttctaattttatgccttaaaataggtttctgattacataaaatttgaatagaacactcaagaagtatgtagatttttgaaaaacccaaacaatattcttcttagatttttggaggcaaaatttagaccagtatactaattcaaaagacaaatatttcagaggaagtggagtacagtatttaacattttgtttgcaattttactttttcttcccttcttccctattgaaccttgattaaaatgtatgaatacaatacttggatttttttttttcagcttagactctgataatttcagtggtagtggggaaacctgaatttgtcagcatgattatttgtaactcagattgttcaaatgtatatagaaggtccccttcaagtgttgtttctccaagtagtcataaatgtagcaagtataaatcagaatatcatcttataatcttacagagttaacctaatgagtcaatacctttataagcaaaaccatgataaatttaaaaacaacagaaatgtggcatgattacttatttatttgttccaggtgactctaaatagttgatttttctgcctgaaggatcctgaacatatttagttaccctgtagttatttaggaatttaaaccagaagactttgaagttgtatattcttgcaatgcataaaatgacattataatcaacaaacttatggtttgtttcaattgatgcacacaaaaaataacttatagttagacttttctatttcaagtaaagctttgagttacttgtttttatacatattcatcatgtaccctttattgtttctaggtgttgatatactttaataaaaatgatatgtttaatattttcccattaatatatttctttgaagctatttgttttaaaagatgtaacacttatttgctgtcaaattctgaattaaaaaatctgttggtggccaggcgcagtggctcatgcctgtaatcccaacattttgggaggccaaggagatggatcacttgaggccaggagttcaagaccagcctggccaacatggcaaaaccccatcactaaaaatacaaaaattacccgggcatggtggtgggtgcctgtaatcccagcttcttaggaggctgaggtaggagaattgcttgaccctgggaggtggaggtggcagtgagccgagatagcaccactgcacttctagttgacagagtgagactctgactcaaaaaaaaaaaaa

SEQ ID NO: 1329 - DNA, 3345 bp, Homo sapiens
attggtgagtggggcagggcaggagggaactgaagagtgagaaagcattatttcagcaaaaggtctttcctcccttgctctctcctccaaccactggctcagcctctccgcccgctgcctgtgaatgatgcaatggaaggtgtgctggggtcgccctgtgtcccgtgcataggagcatctcagcctccaggtcctctcctttggggctcacggcacccccatgctacgaaccgcaggcagggacggcctctgtcgcctgtccacctacttggaagaactcgaggctgtggaactgaagaagttcaagttatacctggggaccgcgacagagctgggagaaggcaagatcccctggggaagcatggagaaggccggtcccctggaaatggcccagctgctcatcacccacttcgggccagaggaggcctggaggttggctctcagcacctttgagcggataaacaggaaggacctgtgggagagaggacagagagaggacctggtgagggataccccacctggtggcccgtcctcacttgggaaccagtcaacatgccttctggaagtctctcttgtcactccaagaaaagatccccaggaaacctacagggactatgtccgcaggaaattccggctcatggaagaccgcaatgcgcgcctaggggaatgtgtcaacctcagccaccggtacacccggctcctgctggtgaaggagcactcaaaccccatgcaggtccagcagcagcttctggacacaggccggggacacgcgaggaccgtgggacaccaggctagccccatcaagatagagaccctctttgagccagacgaggagcgccccgagccaccgcgcaccgtggtcatgcaaggcgcggcagggataggcaagtccatgctggcacacaaggtgatgctggactgggcggacgggaagctcttccaaggcagatttgattatctcttctacatcaactgcagggagatgaaccagagtgccacggaatgcagcatgcaagacctcatcttcagctgctggcctgagcccagcgcgcctctccaggagctcatccgagttcccgagcgcctccttttcatcatcgacggcttcgatgagctcaagccttctttccacgatcctcagggaccctggtgcctctgctgggaggagaaacggcccacggagctgcttcttaacagcttaattcggaagaagctgctccctgagctatctttgctcatcaccacacggcccacggctttggagaagctccaccgtctgctggagcaccccaggcatgtggagatcctgggcttctctgaggcagaaaggaaggaatacttctacaagtatttccacaatgcagagcaggcgggccaagtcttcaattacgtgagggacaacgagcctctcttcaccatgtgcttcgtccccctggtgtgctgggtggtgtgtacctgcctccagcagcagctggagggtggggggctgttgagacagacgtccaggaccaccactgcagtgtacatgctctacctgctgagtctgatgcaacccaagccgggggccccgcgcctccagcccccacccaaccagagagggttgtgctccttggcggcagatgggctctggaatcagaaaatcctatttgaggagcaggacctccggaagcacggcctagacggggaagacgtctctgccttcctcaacatgaacatcttccagaaggacatcaactgtgagaggtactacagcttcatccacttgagtttccaggaattctttgcagctatgtactatatcctggacgagggggagggcggggcaggcccagaccaggacgtgaccaggctgttgaccgagtacgcgttttctgaaaggagcttcctggcactcaccagccgcttcctgtttggactcctgaacgaggagaccaggagccacctggagaagagtctctgctggaaggtctcgccgcacatcaagatggacctgttgcagtggatccaaagcaaagctcagagcgacggctccaccctgcagcagggctccttggagttcttcagctgcttgtacgagatccaggaggaggagtttatccagcaggccctgagccacttccaggtgatcgtggtcagcaacattgcctccaagatggagcacatggtctcctcgttctgtctgaagcgctgcaggagcgcccaggtgctgcacttgtatggcgccacctacagcgcggacggggaagaccgcgcgaggtgctccgcaggagcgcacacgctgttggtgcagctaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgaggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccagtgcaggctgcagatgattcagttgaggaagtgtcagctggagtccggggcttgtcaggagatggcttctgtgctcggcaccaacccacatctggttgagttggacctgacaggaaatgcactggaggatttgggcctgaggttactatgccagggactgaggcacccagtctgcagactacggactttgtgctggatgttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccaggcatggtggcgggcacctgtagtcccagctactcaggaggctgaggcaggagaatcgcttgaacccgggaggtggaggttgcagtgagccgagatcgcgccactgcactccagcctgggcgacagagtgggactccatctc

SEQ ID NO: 1330 - DNA, 2803 bp, Homo sapiens
cgccgccgcgggctcaagcggggcggccgggccagcgcggggcggcggcgggcaggggcggcgagtgcgcgggcgctcgccgccgcccttctcggcgggcagcgcgcgaggaccaggccgaggaggaagtggcggcggcggcggcgggactgcgcgccccagctccgatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggggactgccaagtgtgctttatagaaggctggaagaccgactgaagtaggaagctgtcacatgtttgagccaactgagcaaagcagctgttgcctgccagacagccaccccaagaccaagggagccagcctgtcgtttgtccttctagcctggaagaccagttcttggctcttgggcactcacattggccactggccacaactgctgaatggcttcactaatgtccctggggtctgtatctgccctctcttctattccctagaaactctggccgggcatggcggctcacgcctgtcatcccagcacttagggaggctgaggcaggtggatcacaaggtcaagagatcgacaccatcctggccaacatggtgaaaccccatctctactaaaaatacaaaaattagctggacatggtggtgggcgcctgtagtcccagctacttgggaggctgaggcaggagaattgcttgaactcgggaggcgtaggttgcagtgagccaagatcgcaccactgcactccagcctggcaacagagcaagactcctcaaaaaacaaacaaacaaacaaacaaactctgatcattcacccggtgggatccccggcagctccttctccttcccgagctgtggctcatgggccattggattcagagaccttgagctgggtgctggctgccctaaaggagcacgacccctccagcctggtgaccgggaggcagagaagtgcagctgtccttgacaaaggcccagcctctgctgcctcaggccagcctggccacaccccgatgccacagtcatctgccccgcccaggcataagcctgactcaggtgatacaggcgaggcttctcccatgggtcctccccttgtgagaaagggtctgtgctgtgtaccttctctctgcacagccattgtcagtgtggtttggagtgagtgagcctcccgcactgctcaggggagagctggtgagcatgactccatggcctcctgctggttggggtcttcttctgattctcacccgcaggagcacccagacccccccttttcagaaatgattacattttcccttcaagagtcatctgtgacctggtggtgtggagggactgtcccctcctgcagcctggccgacccccttcctccagggctgtgtggaatcacctctcagaagctcactctgaaaagccactcacagggatttcaccaggatgttgctgttcctgccgacacctgggctttgtgacaaatgctgtttgcttcaagctgttcacaagcaacttcaccagaatcccaagctggttcgtacttaatttgtgtacatacatatgcataatatacatgaccatgtatgagatacagacaccatggcttctgtccattggctcattcgcctggtcgcatgttcactccatgaggttaggacactgcgggtggctttgggatgggtggtttcagggacaaggtgtcgctatgatctctgtatttgctaactagtcttgttttgatttctaacggtctagtggagtacagttaatgttgtgtttatttctgtaactgtaggggtggagtataaacctaacttttggaaacatgaagaaataaacaatagcgccagccgtt

SEQ ID NO: 1331 - DNA, 4007 bp, Homo sapiens
attccctctggctgcggttccgagaatagcctggaaggaggcaggggtcccggctggagaagcgtggctccggggtggggcgtgcagggctagcccgggcgggggacgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaagcacttagagatgcaacaaggagacgcgcctttgccctggtctctcaagcgtatacttcaatcatcgccgatgattttgcagcctttgttggacttcctgtagaagaggctgtgaaaggcatattagaacaaggatggcaagctgattccaccacaagaatggttctgcccagaaagccagttgcaggggccctggatgtttcctttaacaagtttattcccttatcagagcctgctccagttcccccaatacccaatgaacagcagttagccagactgacggattatgtggctttccttgaaaactgatttatcactctgagttcaagattcatcttcagaatcctgtatactgacaaacgtagaaatgtaaagtttgtattttcaatttattggatggcttaagcacctcagcattccttactatgtgataaaatacatatagaatataagatatactatatacattttgtccataaacgttatgctgaatagttgttgaaacagttctcattttgtagtatttaataatctggatggagcctgtcagtattacagttagttttctagtgactcataaaataagatttcctgtttcatgtagaatagtgtttgtcaactgtcttttctctgtcccagcacatgccgtactcttatatgtaccattggttgataattataatgattcatttggacttgaagaaagattgtccccaggcacagtatctgaatcactggggattatgattcaccctctttggagaacatgctctcttttcaccccccacctcctgagagccactaatgtaagatacagaaacatagctgaggaacaaatagaccatttccatactaaaccagtttgttaactttagattttttccaatagtgtgagtatatccattgctggcagtggagggcttgccatgaaaatgcaacttatttaagacatttatgagacatattaacttgtgctgtcgccttttagaaggagaaacttaagtgtggaatgcattatatgggcaaagaagctatgaagatacatgatacactttgtacaactatcctgcagcccattggttgcttatatttatcgcttggctcaagttctgccctttggagaaatactgagcaagtctttcattctctgtgtgacagccctctgaatatttgaagttgtttgttgtaacttaaggttataacagcccttagttcatttactctgcatttgttcaataaatatttaactgaattcttcaattatttcatctaagatagtttctggaaatttcactctcgatctttctgtggacacaatctattttgtcattgtgtctatatgaatctcttaagtagaaatgagttgtatggtgaatctgtgtagtgataattatataatttatttattttgaatgcattttagtggctatttcagtttttcttaacatatatgggaatactttttgaattgcaattttatttaacccggataggtaagtcatattaaaattccttgttttacagttgaggaaatgggaattcaagaagtcagaggatcaggagagtgatcaagagaatgacagtgccagtttttttaacttccaggtattaagtacaaattgtatccatggttattttttaaaagcagattagagtcaatccaaatattcattaataggggattgtttgaataaacagcagtgtagactacgcaggtgtaaaaggagtgaagatctctatactaaactggaatgatctccagagtgagaacatagaaagcacatgtagtttatatggttattttgagggtaacaaaaggagaatgattacaattatatatatgtacatatttccttatatttcaaaactaagcaattgggggatatatacaaaatgaatataatagttccctaaagaggaaggagaggacagtgaactactacatagagaaaaaataatctcaagtgatcaaacacaatatttcaattttacattgtcagtgggatatacactaaggacagaaaaaaatcttagactaatgaatgtggtttttcatgattaatttcacaaaatcttgatatcttttttattattaaaagtatagattaaattaataatcatgtaacattagaccccagtaatcttaaatttgacatggaaacctcattatatgctttatttttctttgtaaacagtaaatatttcccactcctgtctacatgaaaaggtctagagtaattacagttcagtaacaatgagcaccactagtacccagatggtgttctttcattttcatttgcaattaaaaggaatcagaacttatttgcaaaacagctaatagttccagggcagtaagtgtacaagttcatatctggtacaagatgtccaggattcaaggaggctcttaaagacttgggattctgtcaaagggttatacaagccaacttgaagggatttctacaggccatgtaaaaatgagacagtttgagcatgaaatatttgtatatgtgtctgtttttaactcttaataacctcatcactgtacaagaaaggcagggtaagtgcttgatttcacttccctttattatcagttctcaggacaaattgatatgctgccaatctctaaagcaacaaaatcgaacctgtagggtagtcaaaaagctcatgctggaaaattccaccgaataaagataaaagttagaaaaacggtacttgcagcccttaatgaaacaaagaagggatcatggaaatatatatcaatgctgttgagaccacagggtaagaaattgagattgagcatgaaatatgtccagtacatccatcagcctgtctttgtgctctggctatttctgagccagccatctgtgtacaagtgtagcctgacagcaccctgtttcagatccattggatatctctaaaatttgctctgggacttaccctggcactactatcaggatgcccacacaaacctgattgggcagcccatcagcagttgtgaacatgacatggtgaataaacactctcttccttgtc

SEQ ID NO: 1332 - DNA, 5226 bp, Homo sapiens
aatttacctaatcccacgtccctaacggtcttcggaagcgaagcagtgtcaacagtccctggtaaacacaagtagtattacaagtcgggagctcttcaagtcttggatgagactgtagagcggtcttgtgcggcaatgtgctaccttaaaataaataaataaataaacccctgttatgtccggagtttgtttccacccggagaggaatggaagagcaccagagagcgcttagctttctggttggatgttttggtgtgggacttgttttgtgaccaacaatatgaaaggctctgaggtcagcttggagaagaaaaaaaagattaagatgccagtgaagagacttcgtgaggtagtttctcaaaatcatggagatcatttggttttgctgaaagatgagttgccctgtgttcctccggcattgtctgcaaataaacgtcttcctgttggaacggggactagtttgaatggaacatcacgtggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaatgtctcactttgtctcacaggctggagtgatcacagtggggtgatcacaactcactgcagtctctacctcctcaggctcatgagatcctcccacctcagcctcccgagtagctgggactacagagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcgtgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcttcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactgcctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggaggatgatcctcctagtgaagggcaagtgattaggatgtcccataaaaaatttcatgcagatgcaattctttcttttgctaaacaaaaccaggagtcagcagtttcccagcaagcagtctatcattcagaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaagtttcaccaggtgatatggatcggacacaaattgagcttaatccgtacctcacatgtgtattttcaggtttgggggtacatgtgaagaaggtttcctgtataggtaaactcgggctgtggaggtttgtcatacagattatttcatcacccaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttt

SEQ ID NO: 1333 - DNA, 4596 bp, Homo sapiens
atataggaatggtgcttctcctgagacagaggttttgtttagttttttcatctgatactggatatgtcaagatgaatctatgaacttcaagcaaaacttattgaagctttggtatatgtgagtaatttgttttagagaactggagcctatagcgatataaaaaaatagcaaatgcaaacattttatatgaatctactagcatggaaattctcccatgcttaccgtccaagtgaagacttcctctgccatagaacttccagattccttggcattcctgtggatcatcccaatgtggtactgtgaaggcaaggagcttgaaaattccccagatattcacatcgtccaggcaggaaatctgcactcactgaccattgcggaagcctttgaagaggacacaggacgctattcctgctttgcttctaacatctatgggacagattcgacttctgctgagatttatatagaaggggtttcttcttctgactcagaaggcgaccctaacaaggaagagatgaatcgaatccagaagccaaatgaggtgtcatctcctcccactacctctgcagtcattcctccagcagtaccccaagcccagcatttggtggcccaacctcgtgtggcaaccatccagcagtgtcagagccccaccaattacttgcagggattggatggaaaacctatcattgcagctcctgtgtttacaaagatgctacaaaatttgtcagcttctgagggtcagctggttgtctttgaatgcagagtaaaaggagctccatctcctaaggttgagtggtatagagaagggactttaatagaagattctccagattttaggattttacagaaaaaacctcgatccatggcagagccagaggagatttgcaccttggtcattgctgaggtgtttgcagaagattctgggtgcttcacatgtactgcaagcaacaaatacggcacagtgtcaagcattgcacagctgcacgtgagaggaaatgaggacctcagcaacaacgggtctcttcactcagccaactctaccaccaacctggcagctattgagccacagccctccccaccccactcagagcctccatctgtggaacaaccccccaaacccaaactcgagggggttctggtgaaccacaatgagccccggtccagctccaggattgggcttcgtgtgcacttcaacctgcctgaagatgacaaaggaagtgaagcatcctccgaggctggtgtggtgaccaccagacagaccaggcccgattctttccaggagaggttcaacggacaggcaacaaaaaccccagagccttcttcccccgtgaaagagccccctccagttctggccaaacccaaacttgattccactcagttacaacagcttcataaccaagtcttactggaacaacaccaattgcaaaacccacctccttcatctcctaaggagtttcctttcagcatgactgttttgaactccaatgctcccccagcggtgacaacatccagtaagcaggtgaaggctccttcatcacagacgttcagcttggcccggccgaagtatttcttcccctccacgaacaccaccgcagcaactgtggccccttccagctctccggtgttcactttgagcagcactcctcaaactattcagaggacagtgagcaaagaaagcctcttagtgtctcacccctctgtgcaaaccaaatctccaggagggctttccatccaaaatgagccactcccaccaggcccaacagaaccaacaccaccaccattcacattttccatccccagcggaaaccagtttcagccccgctgtgtgtccccaattcctgtctctcctaccagccggattcagaacccagtggctttcctcagctctgttctgccttctctccctgccatcccacccacaaatgccatggggctgcctagaagtgcaccatccatgccatcccagggattagcgaagaaaaatacaaagtctcctcaaccagtgaatgatgataacattcgtgaaactaagaacgcagtgattcgagacttggggaaaaaaataactttcagtgatgtcagaccaaaccagcaggagtacaaaatttcaagctttgagcagaggctgatgaatgaaatagagtttcgcttggaacgtactcctgttgatgaatcagatgatgaaattcaacatgatgagatccccacgggcaagtgtattgctcccatctttgacaagagactcaagcacttccgggtcacagaaggctctccagttacattcacctgcaaaattgttgggatacctgttccaaaggtttactggttcaaagatgggaagcagatttctaagagaaatgagcactgcaaaatgaggcgagaaggagatgggacatgctctctgcacattgaatccactaccagtgatgacgatggcaactacaccatcatggcagccaacccccaggggagaatcagctgttctggccacttgatggtacaaagtttgcccattcgcagtcggctaacctctgctggtcagtctcacaggggaagatcccgagtgcaagaaagagacaaagagcccctacaggaacgctttttccgaccacatttcctgcaggctcctggggatatggtagctcatgaggggcgcctctgtcggctggactgtaaggtgagtggtttaccgcccccggagctgacatggctactcaatggccaacctgtgctaccagatgcctcccacaagatgctggtcagggagaccggagtccactctctgctcattgacccactcactcagcgcgacgcagggacctataagtgcatcgctaccaacaaaaccgggcagaattcttttagtctggagctctctgtagtagccaaagaggtgaagaaagcacctgtgatcctggagaaactacagaactgcggtgttcccgaaggccaccccgtgagactggagtgccgcgtgataggcatgcccccacctgtgttctactggaagaaagacaatgagaccatcccttgcaccagagagaggatcagtatgcaccaggacacaacagggtatgcctgccttctcattcagccagccaagaaatcagacgctggatggtacacgttgtcagccaagaatgaagccggcatcgtgtcgtgcactgccaggctggatatatacgctcagtggcaccatcagatcccaccgcccatgtctgtccggcccagtggcagtcgctacggatctctcaccagtaaaggacttgacatattttctgccttttcctccatggaaagcacgatggtgtattcatgctcttctcggagtgtagtggagagtgatgaactttaagaatgtctaggtacctgctgtgtaagagagcggactgtggagggggaatgagaacaagccagacttggtggtttccaagcaaccgaagttgagtaagttcccacactgctggacctgtggcaaagagtgctttgaataagtcagctagggattcttgcagtctcagctgagggagaaaggtagggctgtgccttctaaagattccaacagagatgtgagaagataatacagatgaaccaaagatgtcacacagttgccatccactgctttgggaaaaaactagcatgctcccctgctccctgttgtgttagggatgtttaggtcatactaggagcaattaggagccatatgcctgggctgagaagagctaggcagtagtgaccttaggatatgactaactcaccaaacaatgccaaggagaaaggcggacaggtcaccatcacctttcatcgattacatgtatagcagtagttttggtgaattcaccaaatcagcttccacttagcattaggaggtcatgccatacaactcacgtatgcgggcaaacacttttgatttgcatatcctgggtgtactgagccacataataaggtgtcaaaatgtgcttgagattccaaaaacttgctgaaacacttgatattgcacagtgcacttattttgtggccaaagcatggccttaccagcttgtctgcactattttcttttgggtggtgactgtttttttctgactttgcatatccctagacactagaactaaaggattggtaataaaccaatcagaaagaaatcctctgtggggtcactttaaaaactactagcttcaactaccacttacaaaatgtgcaagagtcatcatttgcccataaaatacacctcatgggctcctacccctttccccaaaagtctgaaagtgtaggaggaaggaagagatacaaacaaggagaggaaatgatgggagagtgttgtttttgtcacttgccccagcagagcaggggttttggaaggagaggtctttaatagctttgaaatgctttgagatcattggtcaaattgcattttctatgtagagaatattctgctaggtggaaaagttgggagaaaggggaatatgcatctttattctaatcaccaattcaaaccctgcctcttaaggaatttttagacttaagttcactgtgatatccctagtacctagaagagtacctagcacaaagtagacattcaataaatatttgctggttgaa

SEQ ID NO: 1334 - DNA, 1304 bp, Homo sapiens
actaagttcctcctgcgcggtctatggcggactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttatt

SEQ ID NO: 1335 - DNA, 7121 bp, Homo sapiens
aaaagggcggtggggcggggggcggggcagggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatgtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccgtttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtcctttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaata

SEQ ID NO: 1336 - DNA, 1835 bp, Homo sapiens
acgcaagtccctttcctcccgacacgagtgcagtaaagaaaaacggttatgagcgtaaagtgacagcctcggccgatgggaatagggggaagtccgacactgagcaacgaacgcattcccgcgcctccaaaacctaggccgggggcgctggaaacccttaccggcacccggccaccgcggcagacgcttgctcctgccacgccccccccccctcccccgcatcacgtgtctgcactcgctttcctcggattcccggatgtggttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagagatggggttttaccatgttgtccagtctggttttgaacttcgggattcaagcaatccgccagcctcagcgtcccaaagtgctggaattacaagtgtgagctaccaccactggcagttaagaattttaacaatttgtcaatgaaacaagaatctcaattagagtctttatatacaatctgtactgttggaattttcaaataaatattgtaaagaaaatt

SEQ ID NO: 1337 - DNA, 8076 bp, Homo sapiens
atgaggatagaagagaggaaatcccaacatttaacaggtttgacagatgaaaaagtgaaggcatatctttctcttcacccccaggtattagatgaatttgtatctgaaagtgttagtgcagagacagtagagaaatggctgaagaggaagaacaacaaatcagaagatgaatcagctcctaaggaagtcagcaggtaccaagatacgaatatgcagggagttgtatatgaactaaacagctatatagaacaacggttggacacaggaggagacaaccagctactcctctatgaactgagcagcatcattaaaatagccacaaaagccgatggatttgcactgtatttccttggagagtgcaataatagcctgtgtatattcacgccacctgggataaaggaaggaaaaccccgcctcatccctgctgggcccatcactcagggcaccaccgtctctgcttatgtggccaagtccaggaaaacactgctagtagaagacatccttggagatgaacgatttccaagaggtactggactggaatcagggactcgtatccagtctgttctttgcttaccaattgtcactgcaattggtgacttgattggtattctcgagctgtatcggcactggggcaaagaagccttctgtcttagtcaccaggaggttgcaacagcaaatcttgcctgggcttcagtagcaatacatcaggtgcaggtatgcagaggccttgccaaacagacagaattgaatgacttcctactcgacgtatcaaaaacatattttgataacatagttgcaatagattctctacttgaacacataatgatatatgcaaaaaacctggtgaatgccgatcgttgtgcgcttttccaggtggaccataagaacaaggagttatattcagacctttttgatattggagaggaaaaggaaggaaaacctgtcttcaagaagaccaaagagataagattttcaattgagaaaggaattgctggccaagtagcaagaacaggggaagtcctgaacattccagatgcctatgcagacccacgctttaacagagaagtagacttgtacacaggctacaccacgcggaacatcctgtgcatgcccatcgtcagccgaggcagcgtgataggtgtggtgcagatggtcaacaaaatcagtggcagtgccttctctaaaacagatgaaaacaacttcaaaatgtttgccgtcttttgtgctttagccttacactgtgctaatatgtatcatagaattcgccactcagagtgcatttaccgggtaacgatggaaaagctgtcctaccatagcatttgtacttcagaagagtggcaaggtctcatgcaattcacccttcccgtgcgtctctgcaaagaaattgaattattccactttgacattggtccttttgaaaacatgtggcctggaatttttgtctacatggttcatcggtcctgtgggacatcctgctttgagcttgaaaagttgtgtcgttttattatgtctgtgaagaagaactatcggcgggttccttatcacaactggaagcatgcggtcactgtagcacactgcatgtatgccatacttcagaacaatcacacgcttttcacagaccttgagcgcaaaggactgctgattgcgtgtctgtgtcatgacctggaccacaggggcttcagtaacagctacctgcagaagttcgaccaccctctggccgctctctactccacttccaccatggagcagcaccacttctcccagactgtgtccatcctccagttggaagggcacaatatcttctccactctgagctccagtgaatatgagcaggtgcttgagatcatccgcaaagccatcattgccacagaccttgctttatactttggaaacaggaagcagttggaagagatgtaccagaccggatcactaaaccttaataatcaatcacatagagaccgtgtaattggtttgatgatgactgcctgtgacctttgttctgtgacaaaactgtggcccgttacaaaattgacggcaaatgatatatatgcagaattctgggctgagggtgatgaaatgaagaaattgggaatacagcctattcctatgatggacagagacaagaaggatgaagtcccccaaggccagcttgggttctacaatgccgtggccattccctgctatacaacccttacccagatcctccctcccacggagcctcttctgaaagcatgcagggataatctcagtcagtgggagaaggtgattcgaggggaggagactgcaacctggatttcatccccatccgtggctcagaaggcagctgcatctgaagattgagcactggtcaccctgacacgctgtcccacctacagatcctcatcttgcttctttgacattcttttcctttttttggggggggtggggggaacctgcacctggtaactggggtgcaaacctcttcaagaaggtaacatcaaataaataagtcaagcagaggacttcctgccaatctcttctgtgaggcatcatagacactgagcaaccaggaccacccccacgttcagaaatcagctggccaagtgactccatttgacttgcaaaccagccttttctaataggctaatattgctgaggccttaaaggaaatggacaaaaattatccagaaggggtacttttccattgtatctttctaataagggtttaaaatggtactattatggtattgtacttgggctttaacatcaatgttgctttgatgttgttggatataaataggaatttttacacattactattgtgaatggtgaatgttcatgtatgacctacttgtaattaacttgagttgtagtccacagcctcaggacaaatgtcgttgaggttacagagtaagaaatgatggcaaaacgtcaaactcttatttcagagcttcatgaatttagttagactaaacataattctttaagttcaacctaaagggctgagatcaataaatttaacactagacgaagtagacttcctgtctttttgagaagagatgaggtatatgttacaataaatctcagaacttcaagtagcagttcaaaagatgtcagtttttaaaattgtttttgttgttgtcttggcagttttactgaaccctttgcataaagaacaaaataaaagctcggcattgtaatttttttaatggacaagtcttatggatacgaagggtacatttttcataatgattcctttatattttcactttgtgtcattgcagaattttagactctcattcacaatgaaaagtttattttaaacattgtttaattaaaataccatacagttctcttttaaacatcaaaccataaaaagtgtattttgtaattttactctgacctgccgcagtcacctctcacttatctcttccacgtactgcacggtcgtatttcatgagctttctgtccatagcacagaaacagagcagaaagtagtacaatcatgttggaccttctttctgttctctttactcttctcacagatcagatcactccatagaagcctgtgggtttcgatggtttcttctatacacctttttggttgaccagtattactatacaatgtaagtgttttaaaaaatacgaaagtaatactctgcaccccttcctacaaagatgataaagcagtcacttctggcgcattttaataatttaaagatttttagtgcaatggcacggtaacctccaaacctgaattagacagagactcactcaggaagtgacaggcccatcatatcaaataacttattcacttttcatgtggcaggaaactggaatatcgcttttaataaaatggaaaaatatgcttctacatatttaccaccataggcgttttgttcatatgagcctggtttgtgcaaaattaaatcagaggcttctacaacatggtttatttatgttgtagcaaagttggctctacataaacattgttcttattttaaaattaacactatgtgttcagttttcttgtgggcttctgaaagttgccatcttccctccgtggagctccatttgctattttcattatacactatgaggtaaaatgtaataacaaaagagagagaagtaccactgtggctagatatatacacacacatatatatatggatggatgtaatatatgtagaacacacacatagatgtatataggatacacactcatgtatgtaaacgtatacatatgtgtatatatgatacatacacatacacacacacgagagacagaaggaaagagaggaagagagaagcaaacatgtaggaaaaaatataaatcagccccattctcccattctttaagaacaatgatttttcttgatggaaaatgcatatcacttgacagttgacaagaaagtgtcatttttgtgttagtgtatcatataattgaatttgaacaagatacatatttttctgcatacaaatttatgaagctggagtctaccaaacacagctttagtcacaaaagttagtttagttatctcatttcgcttggagatggaatttcaggaagggatatattatttaagattattgtttaattacaagaattttaaaagaatgtatgaattctgttttttaatatagaaaataattatggagttaggaatctcatggctacatttacatttttaggttattacagaaaattctcttaatttattatagtcaagtgtattatgtaatctctatttagaacagtttcccaaaggaatgtgattggatttactggttggttaatttcttgtgaaatattgtcataatagaagcacagcttgaacaaaagactgaattctgatataaactgtcaatattgcttttaccatgtgtaagatttacttagtaatcacagatttacctaaaataaaaggacccgggttgcagtgatatttagttaatgatttgttttggaaaacatgcagttaggagtatttttgtattttgtcagatgtttaggagacagactttcgggtcatgtttcttgtcttgttcccagatcttttcttaaaagaacagtgtgacaccagaagccaagagatggtttttactaacaacagctttgatgagttcctattaaggtcgtattgtgtattgtgccaaattttccacccagtataaatttagtaacccgctatgagcatatgtaggatattcaatttgcagatacttttgttggttatgttggtttataatagacaagttttatggtcatatgcaattattccattatctttttggacacagtgaatatgttttttagctaaaaatgtccttggaaacataaatgcctgccaataacatggaatattgaattcgggcaatgtgaattgattaattagaaaagggtcaaaagaaatacaatggatgtggaaactaattctaaaaaatagccctattaatagggcagagactctggtccatttcccagctgtacttctctctaagaggtgtatgaaaaacccatcttgcaaaagagaccaaaatattagacacaatcgttcccattcctgactcttcaatggaaaaggaaggtacagatgtttacagtggtgccccaggtgactcgttctcaccacaacaaaagcaactaattggaaactagatgtgttcaataatagatttcctcttttttggcatgctttttagattttttttcattttgtaaaatctcagttaatttttctttattggtatatttgtgtatgcgagacaaatcctgtattgtacaggatataaatagatgcataaatccttagatacctgggttttttaataggtttaggtttgggtattgtgtttctggtcttttaactcaaaattaaggtttgagctttaataggactaaattattcacctgccttggcctgtgcctttattttaaatactgcaattttacttcttcattcatgtatttattattttgcttttcttgcttaagtataattgaaaatatttgcaggaacgcacaattcattttatcaagttgaatgaataggaccattctctcctcatcagatttctgttctttatttgacttcattgacatataccctggtgactataaccagtgaactgttcagagtcagtcttttcggcaagaacttcagagaactgtgacactggttatgatgtgattttggggggtttcaggtacctaagcatgatttttaaaatcacttctctctttacatatttcgaacatatgtttgctttctacactttgcagattttatttaggatttaattctttaaagactatattcatttagtcactatagtggatctcttctactgcaagtattcatctgatttttaaattatgtaaaatgtaaatcagccaagtatgtcatccgttatagtttccccatgctttcagcgcatggccatgagatttttacatgtgcataagtatttagccaatacacattttgctgacttctttaaccatttatattgtttaaattagtaatatccaatgcagtgcacacttttttgtcttttttccaacggaatattttggttgtctgtagcgttggaagcattttatatgataaaaatagcaagaaaaaattaaaaagtgtcaacggtgtgctggttctaaattaagaagatagaacaaagagaaagacattaatgttacctaagaaacacatttaacatccgaagaagcaatgctgtcctcacttgatgtttctcttctcaacccagcaatggagagcagggcttgcaaagccgtacagagcctacgtgctctttcctgcaagtgggagaaaactaatcaatggcacacagggccaggtgtggccctgtgaggcaaaggataatgtcacctcaggaccaaggtggaaacttacagctgaatccagggcttactaagtagggaagtcagtttacatatttcagttttcctctgatgtttttgaggtactgtgtatttgcagaagtttaagcagaagggttttgtttctattgtaagttaggttctaaaagtgtataatctgatactctagcccaactgaaatattatatcttgggcgttacagcctttgtctttttctttagtcaccttaatacccagtcctatgctgtatctctgatagcctatataaatgacatataggaatattattttccatatgatctgttgtatggtgtatatgctatgtgttcatttcgtgtgcaagttcagagtgtaatagatttacccagagaaggtgtttctatacaatgcccctacctatttgaaattacatgcttgcccaacacactgtgaaatagttaccaaaatttgtacaaatgcagcatcttcattctttctgagaagacaagatggttttctttacatgaacaaatgaacaaaagagatcctagatccataacgtagctaaggcatctaagagtttgctgttgataatcttgctgaccaaaaactactggagagtaacacaggttatatgccatcacaaatacaatgctcatgaagaactgatttgtagagtcaatgaacctgtgtccagaattttaataggctctctattggaaggagaaagaatttcaagttaacagtatctaactttatcatagttgatgttagtaaattttaaaaaatgattttatatgtatgacaaaaatctttgtaaaatgcgcaagtgcaataatttaaagaggtcttaactttgcatttataaattataaatattgtacatgtgtgtaattttttcatgtattcatttgcagtctttgtatttaaaaaacatttactgttatgtttgtataatagaacagtaatcatttattataatctaggcaagttgtaaataaattcataattcaaacagccagtatatatgcatatatgagtgttatattgcaaaatctttgttttacttacatggttaaagcagcaagaattcttttgttgatatgtaattatacacataaaatatatatatgtatgatacatgaaatatatttagaaatgttcataattttaatggatatcctttggtgtgaataattgaatacagagtttttaaaata

SEQ ID NO: 1338 - DNA, 4959 bp, Homo sapiens
ggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccaaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctgaaaagaa

SEQ ID NO: 1339 - DNA, 3646 bp, Homo sapiens
gctcagcctaacggaagtggaggagccggacctctttgtgggaagcgaattgaatcaccttggcaacccgcggggcgtgcagcaacgccctttcctccggaagtgggtgtcagaacctccacgtgctgtccctccccctccccttttcggcccagtagcggcggctcagttgctgccatggagtcagccgggctagagcagctcctacgggagctgctgctaccggacaccgagcgcatccgtcgggccacggaacagctccagatcgttcttcgggcccccgccgctttgccggctctctgcgacctgctagcctcggcggccgacccccagatccgccagtttgcggccgtgctgacccgcagacgactgaacacccgctggcgacggctggcggcggagcaacgggagagcctcaagtccctgatcctgacggccctgcagagagaaacagagcactgtgtgagcctcagcctggcccagctctcagccaccatttttcgaaaggaaggcttggaggcctggccacagcttttgcagctgcttcagcacagtacccacagcccccacagcccagagagagagatggggcttttgctgctaagtgtggtggtgacctcccggcccgaggccttccaaccccaccaccgggagcttcttcggcttctgaatgagactcttggtgaggtgggctctcctgggctgctcttctactccctgcgcactctgaccaccatggctccctacctcagcactgaagatgtgcctctcgctcggatgttggtgcccaagctgatcatggccatgcagactctgatccccatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagagcaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgaccctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttgaacaata

SEQ ID NO: 1340 - DNA, 7441 bp, Homo sapiens
gaggcggggccaggacggcgggaccggccgctgggtcccagcgagggctgagccgggcggtgggaggaggtcaggatggtgggggaacggcatgctggggacctcatggtgcccttagggcctcggctgcaggcatatcctgaagaactcattcgacagaggcctgggcatgacgggcatcctgaatacctgatccgatggagtgtcctgaagtgtggggaagtgggcaaagtgggtgtggaagaaggcaaagcagagcacatcctcatgtggctgtcggctcctgaggtctacgccaactgccctgggctgttaggtgagcgggcactatctaagggacttcagcacgaaccagctggggtttcaggaagctttcctcgagatccaggaggcctggatgaagtggcaatgggagagatggaggctgatgttcaggcgctggtacgcagggcggccaggcagctggcagaaagtgggaccccaagcctcacggccgctgtgcttcacaccatccacgtgctcagtgcctacgccagcatcgggcccctcactggtgtcttcagggagacaggagccctggacctgctcatgcacatgttatgcaatcctgagcctcagatccgccggagtgcaggcaaaatgctgcaggctctggcagcccacgatgctgggagtcgggctcacgtccttctatcactgagccagcaagatggcatcgagcagcacatggattttgacagtcgctatacattgctggagctgtttgcagaaaccacatcctctgaagaacactgcatggcctttgagggcattcatctgcctcagatcccaggaaagctgcttttctccttggtgaagcgctacctttgtgtcacgtccctcctggatcagctgaatagcagtccagagctgggagctggagaccaaagctccccatgtgccacaagagagaaaagccggggacagcgggaactggagttcagcatggctgtgggcaacctcatctctgagcttgtgcggagcatgggctgggcccggaacctcagcgaacagggcatgtcacctccccggccaacccggtccatctttcagccctacatttcaggccccagccttttactccccaccattgtcaccacccccagaagacaagggtgggtcttccgccagcgctctgaattctccagccgtagtggctatggagaatatgtgcagcagacactccagccagggatgcgagtgcggatgctggatgattatgaggagatcagtgctggggacgagggcgagttccggcagagcaacaacggcattccccctgtgcagaccctgggtgaaaaggccctaggtgagatctctgtgtccgtggaaatggccgagagtctgctgcaggttctcagtagtcgatttgagggcagcactctcaatgacctgctcaactcccagatctacaccaagtatgggctgctgtctaatgaaccaagcagctcgtctacttcacgaaatcactcctgtaccccagatccagaagaggagtccaagtcggaggccagcttctcagaggaagagactgagtccctcaaagcaaaggccgaggcccctaagacagaggccgagcccaccaagacaaggaccgagacccccatggcacagagtgattctcagctgtttaaccagcttctggtgactgaggggatgaccctgcccactgagatgaaggaggcagccagtgaaatggccagagccttgcggggtcccggtcctcgcagctccctggatcagcatgtggcagcggtcgtggccactgtgcagatatccagcttggacacaaacctgcagctttcagggctctctgccctctctcaggctgtggaggaggtcactgagcgggaccaccctctggtccgtcctgacagatcgctgagagagaagctagtgaagatgctggtggagctgctgaccaaccaggtgggagagaagatggtggtcgtgcaggccctgcgcctcctttacctgctcatgaccaagcacgagtggcggccgctctttgccagggagggtggcatctatgctgtgctggtctgcatgcaagaatataagacttctgtcttggtgcagcaggctgggctggcggcactgaagatgctggccgtcgccagctcctcggagatccccacttttgttactggccgagattctatccactctttgtttgatgctcagatgaccagagagatcttcgccagcatcgactcagccacacgcccgggctctgagagcctgctcctcactgtccctgcagccgtgatcctgatgctgaatactgaggggtgctcttctgcagcgagaaatggcttactcctgctcaacctacttttgtgcaaccaccacactctgggagaccagattataacccaagagctgagagacacgttgtttaggcactcagggatagcaccaagaacagaacctatgcctaccacacgcaccatcctcatgatgcttctcaatcgctactcagagccgccgggcagccctgagcgtgcagcactagagacccccatcatccagggtcaggatgggtcccctgagctactgattcgatccctggttgggggcccatctgcagaactactcctggacttggagcgtgtgctgtgccgtgagggcagccccggaggtgccgtgaggcccctcctcaagcgcctccagcaggagacccagcctttcctcctgttgctgcggactctggatgctccggggcccaacaagactctgctgctgtctgtgctgagggtcataacccgactgctggatttccctgaggcaatggtcctcccctggcacgaggtcttggagccctgcctcaactgcctgagtggccctagcagtgactccgagattgttcaggagctgacctgcttcctacatcgcctggcctcgatgcataaggactatgctgtggtgctctgctgcctgggagcaaaagagatcctctccaaagtcctggacaagcactcagctcagctgctgctgggctgtgagcttcgggacctggtgacagagtgtgagaagtacgcacagctctatagcaacctcacctccagcatcctggccggctgcattcagatggtgctgggccagatcgaagaccacagacgaacccaccaacccatcaatatccccttctttgatgtgttcctcaggcatctctgccagggctccagtgtggaagtgaaggaggacaagtgctgggagaaggtggaggtgtcctccaacccgcaccgagccagcaagctgacggaccacaaccccaagacctactgggagtccaacggcagcaccggctcccactacatcaccctgcacatgcaccgtggtgttcttgttaggcagctcactttgctggtggccagtgaggactcaagctacatgccagccagggtggtggtgtttgggggtgacagcaccagctgcatcggcactgagctcaacacggtgaatgtgatgccctctgccagccgggtgatcctcttggagaacctgaaccgcttctggcccatcatccagatccgcataaagcgctgccagcagggcggcattgacacccgggttcggggtgtggaggtcctgggccctaagcccacattctggccactgttccgggagcagctgtgtcgccgaacatgtctcttctacacaattcgggcacaagcctggagccgggacatagcagaggaccaccggcgcctcctccagctctgtcccagactgaacagggttttgcgccacgagcagaattttgctgaccgcttcctccctgatgatgaggccgcccaggcactgggcaagacctgctgggaggccctggtcagccccctggtgcagaacatcacctctcccgatgcggaaggcgtgagtgccctgggatggctgctggatcagtacttagaacagagagagacctctcggaaccccttgagtcgagcagcgtcctttgcttctcgagttcgtcgcctttgccacttgctggtgcatgtggaacctcctcctgggccttctcctgagccatccactcggcccttcagcaagaacagcaagggtcgggaccggagcccggcgccttcgccagtgcttccaagcagcagcctgaggaacataacccagtgctggctgagcgtggtgcaggagcaggtcagcagattcctggctgcagcttggagggccccagactttgtgcctcgttactgtaaactctatgagcacttgcagagagcaggctccgagctgtttgggcctcgggcagccttcatgctggctctgcgcagtggcttctctggcgccttgctgcagcagtccttcctcactgctgctcacatgagtgagcagtttgccaggtacattgaccaacagatccagggtggcctgattggtggagcccctggagtggaaatgctggggcagcttcagcggcacctggaacccattatggtcctttctggtctggaactggccacaacttttgagcacttctatcagcattatatggcggaccgtctcctgagctttggttcgagctggctggagggggctgtgctagagcagattggcctctgttttcccaaccgcctcccacagctgatgctgcagagcctgagcacctctgaggagctgcagcgccagttccacctcttccagctccagcggctcgacaagttgttcttggagcaggaagatgaggaggaaaagagactagaggaagaggaggaggaagaggaggaagaggaagctgagaaagaattatttatcgaagatccaagtccagccatttctatactggtcctgtcaccacgctgctggcccgtctccccactctgctacctgtaccatcccagaaagtgccttcccacagaattctgtgatgcccttgaccgtttctccagtttctacagccagagtcagaaccatccagtcctggacatgggaccacatcggcgactgcagtggacgtggctgggccgggctgagctgcagtttgggaagcagatactgcatgtgtccaccgtgcagatgtggctgctgctgaaattcaatcagacagaggaggtgtcagtagagaccttgctgaaggattctgacctctccccagagctgctgctccaggcactcgtgcccctcacctcagggaatggccctttgaccctgcatgagggccaggactttccacacgggggtgtgctgcggcttcatgagcctgggccccagcgcagtggggaggccctgtggctgatacctccccaggcatacctgaacgtagagaaggatgaaggccgaaccctggaacagaagaggaatctcttgagctgtcttcttgttcgtattctcaaagcccatggggaaaagggcctccacattgatcagctggtttgtctggtgctggaggcctggcagaagggtccaaatcctcctggaaccctgggccacactgttgctgggggtgtggcctgtaccagtacagatgtcctctcttgcatcctgcacctcttaggccagggctacgtgaaacggcgtgatgaccggccccagatcctgatgtatgccgctccagagcccatggggccctgccggggtcaggcagatgtccctttctgtggcagccagagcgaaacctccaagcccagcccagaagctgtggctaccctggcatctctacagctgcctgcaggccgcaccatgagcccccaggaagtagaagggttgatgaagcagacggtgcgtcaggtgcaggagacgctgaacttagagccagatgtcgctcagcaccttttggctcattcccactggggcgctgaacagctgctgcagagctacagtgaggaccctgagccactgctgctggcagctgggctgtgcgtacaccaggctcaggctgtacccgtacggcctgaccactgccccgtctgtgtgagccccctggggtgtgacgacgacctgccctctctctgctgcatgcactattgctgtaagtcttgctggaatgagtacctgacaactcggatcgagcagaaccttgttttgaattgcacctgccccattgccgactgccccgcccagcccaccggagccttcattcgtgccatcgtctcctcgccagaggtcatctccaagtatgagaaggcgctcctgcgtggctatgtggagagctgctccaacctgacctggtgcaccaacccccagggctgcgaccgcatcctgtgccgccagggcctgggctgtgggaccacctgctccaagtgtggctgggcctcttgcttcaactgtagcttccctgaggcacactaccctgctagctgtggccatatgtctcagtgggtcgacgacggtggctactatgacggcatgagcgtggaggcgcagagcaagcacctggccaagctcatctccaagcgctgtcccagctgtcaggctcccatcgagaagaacgaggggtgcctgcacatgacctgtgccaaatgtaaccatggattctgctggcgctgcctcaagtcctggaagccaaatcacaaagactattacaactgctctgccatggtaagcaaggcagctcgccaggagaagcggtttcaggactataatgagaggtgcactttccatcaccaggcgcgggagtttgctgtgaacttgcggaaccgggtgtctgccatccatgaagtgcccccgcccagatccttcaccttcctcaatgatgcctgccagggactggagcaggctcggaaggtgctggcctacgcctgcgtgtacagcttctacagccaggacgcagagtacatggatgtggtggagcagcagacagagaacctggagctgcacaccaatgccctgcagatcctcctggaggaaaccctgctgcggtgcagagacctggcctcctccctgcgcctcctgcgggccgactgcctcagcacgggcatggagctgctccggcggatccaggagaggctgcttgccatcctgcagcattctgcccaggatttccgggttggtcttcagagtccatcagtagaggcctgggaggcaaaaggacccaacatgcctggcagtcagccccaggcctcctcagggccagaggcagaagaggaggaggaagacgatgaggatgatgtgcccgagtggcagcaggatgagtttgatgaggagctggacaatgacagcttctcctacgatgagtctgagaacctggaccaagagactttcttctttggtgatgaggaagaggatgaagatgaggcctatgactgagggggcagatgcaggaaacacctagagcagccccagagtcacggggctgagggggcgggagctgcccctgtcatagggagggggattcccagcgtctgtagtgcttcctgtttgctgaataaaggtctctttctcacacaca

SEQ ID NO: 1341 - DNA, 4857 bp, Homo sapiens
cctgtgctggatcctgggcggcctgaggggtacggagactctgggggagggagacggcagcggcatggcggccgggtgtaagacgcccgaccctcctcttccctgtcttcgccgccgccgctgctggagtcactgggaccctgtagtctgcgtgtgttagttgtaatcccgccgccctcctgtcagccctccgctccgccggccctccttccttccgccgccgcagccagcccgagggtcggccggctgtgtaacactctcccaccccacccaccagcccgcgggccagcaccatggaggacgtgaagctggagttcccttcccttccacagtgcaaggaagacgccgaggagtggacctaccctatgagacgagagatgcaggaaattttacctggattgttcttaggcccatattcatctgctatgaaaagcaagctacctgtactacagaaacatggaataacccatataatatgcatacgacaaaatattgaagcaaactttattaaaccaaactttcagcagttatttagatatttagtcctggatattgcagataatccagttgaaaatataatacgttttttccctatgactaaggaatttattgatgggagcttacaaatgggaggaaaagttcttgtgcatggaaatgcagggatctccagaagtgcagcctttgttattgcatacattatggaaacatttggaatgaagtacagagatgcttttgcttatgttcaagaaagaagattttgtattaatcctaatgctggatttgtccatcaacttcaggaatatgaagccatctacctagcaaaattaacaatacagatgatgtcaccactccagatagaaaggtcattatctgttcattctggtaccacaggcagtttgaagagaacacatgaagaagaggatgattttggaaccatgcaagtggcgactgcacagaatggctgacttgaagagcaacatcatagagtgtgaatttctatttgggaaggagaaaatacaagagaaaattataatgtaaaatggtaaaaacataagtagtttttttttcaattacatgttgcttccagacatacttctctgcaacttgttgagcaacattttaagatgttggacttctgcaatagatgacactgatggttttactcctttttttaaaaacacatgcgcgcgcacacacacatgctttacaagttttattataaaccaagaattttggacttgcaaagaggtattattgcaataatgcacttttcatacttgaaatttatttgtatgatataaagttattactttaaacaaaatgcaagtatggggggattgtttataaagtttgggtaatttataacaaaatttgctaaggtttgctaaaaattcatttttctgttctatatattacatttttaacataattttacagttcaattttatgatggagcctcttacagaaacattaacaaaatgcaggaatctgccacatttcttttttagtataacttaatagcttaattaccattttattttttatacttcttccattattaatctttaaatcatgatcctaattagctgtccttactttaacttgatctaattattgcttcctttcttattactttcctaatttttctatattttaaaaactacagtttccatgataaaaggaaaacgttttgatttatagtaccaagtgcttaaacacaaggatagtgttagattttcgagtgactttcctttttgcattttttggcagtaaaagccaaacgttgtatttgttcttttcagagttgtccagcccttttttcctttgtccaaaatgattctaaatagaatctaataaaccaatgtagcattatttttttctaaatgaagccccaaaaaagaaaagtgccttgcatcatttaaaaaaaataattaaatcctcatggcctctaaattagtatgtagaacactgaaaagttcttaacatttttgtgtaatttcctttctttttaaaccataaattagtttaaactgaaagtacgaggctggaagaaatattagtaaattatttggaatatagaatgtttactctttctttttatgttgtcttaatgattctgtgagattgttccggctcaaacagaagcttttctttggggaaggtgatttgtgggagactagtgtattttaaattagcattttaatccattcttgacattcagttagtccagatctgccccataatttgctttagtaaagtcactttatggatttttggctatgttttagtttgtgtgtataaaagttctaagaaaacatttttgctattttaagtatgtaagggaagagaggagtgtttttaactttttatagttgatgactttagggtagcacaaacaaaactcctttgtatctaacttttctcaatcctctcttgaggtgctttactaatgggaatgatttctgtatgttcccttggtaccaagaggtactatgcaaagtaacctattacaccaagttacttgctttgctttcctctctatgatgtgataatacagtaaaagctttcttacccagcatagtgggagagtggagattaattaaaattgttaattaagagttaattcctattgacccaggtgatatttctcttctgatttccctccccttcccttctcttatcttaccactgtgaaaacagcatattgttaatctcgttgtcgtccagtattctgctttgtgattaggtcttttgatgtacagtggtctagtggagtcaagattcgcattgggttttctaaaattccagttgataaaagttccagataacacagctttcctgtatatagatcactattgggcaggtcagcaaagatctcttacagtgtaataataatctatgatgcttcatttagcagaaactctgcttaaaagaatcttcataatagtaagtttaggttttaaaaacttgtttcataaatatacatatatcctctctagtagtctggccaaaagaacagattttgttattgataatttgtagctggtaattttccacattttctatccactgtaatttttatgttgtcactgaagtgcctgcccagtactgtatattacagtctctcacaaacactgggaaaagggactgtcatcatcttgagtactctgtgtgtatatatatatatatagatagatagatttttttttttttttgagacagagtctctaatgtcacccaggctggagtacagtggcacaatcttggctcactgcaacctccacctcctgggttcaagtgattttcctgcctcagcctcccaagtagctggggttagaggcacatgccaccatgcctggctaatttttgtagttttagtagagatggggtttcaccatgttggccaggctggtctcaaactcctgacctcaagtgatccacccacctcggcctcccaaagtgctgggattacaggcgtgagccactgcgcctggctgagtacaatattaatgtagacaaaccatgaagtttattatttcatataagaacattacaggtttgttttttcttgcatgtctgtccacctaatgtttaagtagttctggtagctcttcctattctttattctatttgattccatttctgtgattcttttattaccactgatgttttgtgatagttaactatgataaatttaactgatcatgatttatcttctagagtatttaaataatgtatgagtgaccacccaattccaacattaaaagtgtaatctgggcccataatttatagtgaaattgtatcaaaacatagggaaactgtattactgtccattttgaaaatatgaaacttgagtattgaaaatattcaaacatggaatggcagtattctaatttcagttagttggttcatgttaatttcttacctgttagatgtttaaactgcagtgacctttacttgtatctactctgtggtggaaatgttaaaccatgatagcttttgctaccaactcaaccacttaacttttagagcagttttggggagagtttatgcttcatctgagtttagaagtaatgtcagaaaatgttaagcatgtctgtattaagaaaatataaggtttctaattgtcttattaatatggtaattcaagtgaattagaaatatttaactgcaatcttgaattataaagttgagatatatatatatatgtatcaagatctcaacttgatgtaaagtaaatgagcagttacctggcggatttttttttttttaaataactgatttaatccataatcccataacaaacatagcttcacctcagtattttctttctttctttgttcaacagtgctccgataagggaatgctagaaaatagatgagaagtactgaaagacctttttttttaattgattagaaaagtaagtctctagggtctttgaatgctggaatttttttttttttttttgtctttcccatctgtggcagctaaaacaaaaatcactcaaaatattcaggtttacatgttagctctctctcatagggagctgccatacctcacagttcaaagtgtattctatagatcagtaacattatactgacatgtaattgcaatttactatgcagcaaaaatgattcaagaagaaaaataacctacagtgtctgtatacctttgtatacacaattgcttaagttactctgcttttaacatttgtacttggataaaatgcttatgtctgtataggaatgtcacagtgcaagatgctgctagcccaggcacaaagtattaaaattattttgtgaagattggtggttgtattaaaactgctgtgccattatacctccaaaatattgaaaa

SEQ ID NO: 1342 - DNA, 2707 bp, Homo sapiens
ggaaatggctgcgagaccctagaggcctgcggcctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcag

SEQ ID NO: 1343 - DNA, 943 bp, Homo sapiens
aacctcacgaggccttacgtgcctagagcggttcctctccgtggcgccctaccgccttcggcgcgaaggtggctggtgcgtaccgtcccgaaccctaggagccgaggtgagcgccgcgaagacccccgacattaagaagtggtgtccaccgcagcccccttaagccggataccctcccccaccccgaggagcaagcctgccttccgccacgcgccgcccgtcttccgcgcccgcgcagaacctcgcggctgtgcccgcctaaagccacgcccatcctctcttggccacgccctcagagactcctcccctgtcgcccagatcccacccgcaggaccccaaaacccaatgatcctgcagcagcccttgcagcgaggcccccagggaggggcccagcgcctcccgcgggccgccttgggggtgacttggggcctggacgccagggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaggaa

SEQ ID NO: 1344 - DNA, 3205 bp, Homo sapiens
ttctaacagctgggtgcgggtggagctgcgggcgatcgccagctcgagtgcagattccttgctgtgaccgaggttcagagtgagctctgtcggtgtgtcagtttgcctcttcaggtgattgcacgtctgtgtgcgagtctctccgtgtatgggtggctatgattagggtgagcctcagactggaactcaagtctaagttcattcactgctccagcaggcactcttcaatgaaacctcatcagcagatcgggctctcttcccttgccttgcctcctaacccccctaggccaggtgagggggacagggtactgggaggtaagaaggaactcttctgcaaggagggctctcacgtctgtcttaggcctgctccttaccagagtctttggggaagcagtagggagggcctgagggtctcaggaaaggctctctgctggtctggctctgctctgtagctccatctatttccctgtcccaggtcctttcttcctcctaaccccattgactctgaccatcccctgcccagagcctgaggtcccttctctggcccctctgctgggctggcccatgcaggtgaggccccgcatctggcatcctggaactggcagttggagcctgagctatgggcaaggtcacttcgacagcagttgaatgcccagctcctcatggtcccggaggagaggagggtaggtttgtcttctgatgagacatcatctgattcccttaagtcttggcactccatatgtgtcttggacagcaaagaacagcccttggcctgccagcagaaacagaggcagttcgtgaagccagtgactgagtcagagcagcccacagtgctggaactcctgctagctgagctccgaactctgttctcagctgtgttgcaggacagtagccctgcagcttggcgctatcttcatgcagtactgggtctactgcctccatatcgtgagttgctagttggccaccttgatttgctgcccttcctggagcagctgtactgctgggcaccctgggtccaaacccacctccatctggacctgctaggtgccattgtccaggcctttcctccagacagctctttgttagacagtgcttcccatgctgactgctgtccccagaagcggaggctccatcacaggcccccatgcccagcttgcccttttgtgcaggcccagtggagcaggcagcaagtaaaggaggagctggccacctggctgcgaccattgacactgcctgagctacagcgctgcctgggcattgttggtgctcaggtggccctagaagaggctgtgtggctggatggacttagtctccttcccttggcactggcagcggacatccctgtacggtatgaaagcagtgacactgacaatgcagaggtggagcctgttggaagaaaagagaccaggtctcagcttgactatgaagttcccagggaaaaggccttccaaaagagcagcaccggcttttcacctgagacttccttcctggatagccaggtgatgactgctctgaagatggagagatacctgaagaagatccacttcctctatctcaatgtggctcccagccggtactttaggccttacagcctgatggtggtgccacccgacaaggtgaatcccgagcactacatcttctctccctttgggatcttgcatgtacatcctgtggaaggtagcgagacgatgacactgggtacctggcaccatcactgtgttctctggcagcagctccagttcattccattctttaagtattgcctcttacgcaagtcctttacctgttggaagaagaatgtgagattacaggggctgcatcgactccagaaattcctagagaatcatctgctcttggctgtgccccactttggagctgggctactccatattagcaggcttctgcaggagctacactctgtgtcctggctaccccaggaactggatcggtgctatgagctgctggacctgcagacggctctagccgaggagaagcataaggctctacggctgctccatcgttgcctaaacctctgcacatccattcttcgactggttcacgaggacacataccacatgcaacagtgcctacaggagcgagtacaaaactgtgacaggatcaggacaggccaaggctccatataccttcagagggtacagcacaagcaactggagcagaagctgaagcaagcagaggcctggtggctgcagctgggaaagtttgcccgcctggttgactacatgatttgtcagagcctcatttctgtcttggaagagcagataacctcttttgtggccaacatccttcaagccccaaggcagaaaccctttctctcatcacagctggtctttgatgatcatggtcaactgtctcatgtgccctgtgttgaaaatatgatccagactctaactggaggcctacagtctgtcaagacctctgccttgcaggtattctgaattgggcagagagctggctgtgggaattcccagttcctatcctctgagtaatcagaagctcacaacctggtttgaatccctcattgctttcccatttctgccccttctccatatcctggcatgaaggtagtgcagtctgcagacctgaagacctcctcggattccctgtattctgaaggtatttagggagacctaggcagggggtaggaaggctgaaggagggaaagggcacaagtactaatggcatgggaagaaggcaggaggtccaggctatagagtcaggcactgggtgtggatggagcagctctaacctgggtactgcacatatgtgttgtgggtagaaaggtcagggaatgtttttgctcacaaattcacgtggttatgtgtatgtgcgtgcaatgagagggtgtatgaaagagtgtgagtacattgtccttccaaacctgattcatcccaaactctgtgaggtttttctccagtgccataattgcatttcatttactactgaattttattgctaagtaaatttgtacttgtttgaagagctctgcttgctcaacacttgctttatgtcatatagctctttttcatttcatatggattaattcattgtattgaaatattttatggttaccaattattattggttatcagtcttcacacttattaaccatcagcgtggaaacacatcttcacatttcccttatttaggatactaatgctgtcacaaataaaatcattaaatgcaa

SEQ ID NO: 1345 - DNA, 2498 bp, Homo sapiens
gagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgtttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 1346 - DNA, 2195 bp, Homo sapiens
gcggtgcccggggcatctccgcggcggaactcagggaaggagctagctggggcgggggtgatgatccaggctgggttccagcatagggctcttggtgggcacgctggggtcgggtggaatgcaggagagagaggaggtgggacaggtgggtacctgggctggaggcagggcctgaggtgggcaggtgcagagggctgcacttctcggctgaagccgggaatgaggaccccgctctcgggtgggattggaggggacccgcggctgaggcgctgggctgcgacagggacatcaccgttctcctcctcagggagatggtgctcgtcgtgcacggcttcccgtcctccgtggccgcccttcggtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaattaaaat

SEQ ID NO: 1347 - DNA, 2293 bp, Homo sapiens
ttccccactcccccgccctccccagggccctgggaaggggctcagcgtgggaaaggatggttgagttttaaccagaggcaaagcgtgagcgggatcagtgtgtgcggaacgcaagcagccgagagcggagaggcgccgctgtagttaactcctccctgcccgccgcgccgaccctccccaggaacccccagggagccagcatgaagcgagctcaccccgagtacagctcctcggacagcgagctggacgagaccatcgaggtggagaaggagagtgcggacgagaatggaaacttgagttcggctctaggttccatgtccccaactacatcttcccagattttggccagaaaaagacggagaggaataattgagaagcgccgacgagaccggatcaataacagtttgtctgagctgagaaggctggtacccagtgcttttgagaagcagggatctgctaagctagaaaaagccgagatcctgcagatgaccgtggatcacctgaaaatgctgcatacggcaggagggaaaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttatcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagattaaggtgttgtataaataatattcttttggggggaggggaactatattgaattttatatttctgagcaaagcgttgacaaatcagatgatcagctttatccaagaaagaagactagtaaattgtctgcctcctatagcagaaaggtgaatgtacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagtacagtggaaactgttaaatgcataacctaattttcctgggactgccatattttcttttaactggaaatttttatgtgagttttccttttggtgcatggaactgtggttgccaaggtatttaaaagggctttcctgcctccttctctttgatttatttaatttgatttgggctataaaatatcatttttcaggtttattcttttagcaggtgtagttaaacgacctccactgaactgggtttgacctctgttgtactgatgtgttgtgactaaataaaaaagaaagaacaaagta

SEQ ID NO: 1348 - DNA, 3391 bp, Homo sapiens
ctgcctttctcggaacggaacggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaaaacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtcttgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatatgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatgatgaatactttctcagtttctttttcctgaaatataaattgggatttaagactgtacctaactattaagatcactgtgtaaaactaagtgtctctaaatgtaatgcatcgatttagtgtctggaacataataaatatttgctctcatgattgctaaaaa

SEQ ID NO: 1349 - DNA, 5787 bp, Homo sapiens
aaaagggcggtggggcggggggcggggcagggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatgtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtatcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagctcccagaagcaaaaggcttttacttccaaaagataacaacggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaacctattccagaataagttttgtgttggcttgtgaagcattgatgtcattttttttaattgtggactatttagatgtgtttgtgttcagcaaaatgtgatgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtcctttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaata

SEQ ID NO: 1350 - DNA, 2981 bp, Homo sapiens
agtgtaatgctagaagtcctagaagaaatttggagtgtgcgtgcgcgccgagcgcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggcctagccccaggcccagcccccagcccagcccccagccccacagtagcccctgacccagccccagacgcctaccgtccagtggggctgaccaaggccgtgctgtccctgcacacacagaaggaagagcaagccttcctcagccgcttccgagacctgggcaggctgcgtggactcgacagctcttccacagctccctcagcccttggcgagcgaggtagccacctggggcctcctggagcctgccctctgcccagtctaggactggattgttggggggtgggtcttaagggaggtgtttctgctccagggacccaggctggtgttgcttccaccactaggccctgcctagggacaggcccctcgctagcttctccccactaggatggggttccgggctgcagccagaggagggcagcctggggggatggcactgggatgggcaggcagaggtgctgtctccaggtaagcgacttcaggcctagcctgggggcaggggcaggaagtatgcccacttaggagtcagttgtcactgatgaagagacatgcatagattctgggccaactctgggtggggtctgggcttcaagggcaggtggaaggcagcccctccaggtgcctgagggagatcccctgcaggcagacgcaggactcaggactgggctttccagccccactcttcactccattgcaagctaggcagaatacggcctcgatgggcaggaggaatgcctaggctggcagtgcccacaggagtttggcggaccagagccatctgt

SEQ ID NO: 1351 - DNA, 2924 bp, Homo sapiens
ggttgcgcgggagactatggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtgggtgtgttcctgtggggcgtagcccactcgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccagtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaagggttccctagtgtcccgggaagccagcgataaggaaaaggttaaagaattgcccacccttaaggatatggactttctcaacaagaaccagaaagtatatattggtgaagaggagaagaaaatatttctggagaagctgaagagagatgtggagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctcttgtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgctaagaagaaagcagctcatgcagccaaaactgtcaagcatggggctggggcagagatctctactgtccatccggagcagtatgctaagcgattcctggattttattaccaacatctttgcctaagagactgcctggttctctctgatgttcaaggtggtggggttctgagacacttgggggaattgtggggatattctagccaccagttctcttcttcctttgctaaattcaggctgcaggctccttccatccagataactccatcctgtcgagtaggctctttctgaccctcagaaatacattgtcctttttcctctttgcccatttttcttccctctcttcctccccatgagaagtctgcttgtagtattagaatgttattgttgactctctcccaagtgccttgatctttgtaatatctcctgttgtttctatgatataggagctaggggaagggggttgtttgccttcttcaggacctgactggacagatggacctggctcaagcaactactctggatgcactttgctgtgtgggatgaactaaaagtgtctgaattttgctgataactttataaaactcactatggcatgcttccctcctggtgggccctaggatggatgacactcaagatactacagatgtgggtgcaggcatgcacacacacgatggaatatggccattcctacacaggtggggtagagagtgggtcagcagcctggcacctcacagaggtgggacctaagaggactcatgattatgcagagaattggattgggtctctgtcatagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtgggtgtgtggccagttttggaggctggaatgatgggccagggtgtaggattcattctccatgtaaagtttcctttcatcctgcctagccatccccaaggtttatttccagaagaaaggaatatctctacttggatcaattctggtcatttcaagaggatggaggcctcaagtgtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgtatctggctggactgatctgtctcacaagaagccatgaggccatagggagaagctccctctccccttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaa

SEQ ID NO: 1352 - DNA, 2296 bp, Homo sapiens
ggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccaggttcttgatcaatatgaacgagaaggatttaacttcctagccaaggtgtttaattcttcacattccttcttagaagacttgactggtcttacattgctgcatcaagaaacccaagctgctgagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctggga

SEQ ID NO: 1353 - DNA, 1484 bp, Homo sapiens
gagttccgtattctagttctgtgtgatctgatctttaccttcccttccttggatccctgtgcacctactggagccaggttactctgggtcctggacctgactgcctcattctggaggcttccagacagccacagttagtgcccaaacctgagaggatggcttcagatggagcatctgcattgccgggaccggatatgagcatgaaacctagtgccgccccgtctccatcccctgcacttccctttctcccaccaacttctgacccaccagaccacccacccagggagccacctccacagcccatcatgccttcagtattctctccagacaaccctctgatgctctctgctttccccagctcactgttggtgacaggggatgggggcccttgcctcagtggggctggggctggcaaggtcattgtcaaagtcaagacagaaggggggtcagctgagccctctcaaactcagaactttatccttactcagactgccctcaattcgactgccccgggcactccctgtggaggccttgagggtcctgcacctccatttgtgacagcatctaatgtgaagaccattctgccctctaaggctgttggtgtcagccaggagggtcctccaggccttccgcctcagcctccaccaccagttgctcaactggtccccattgtgcccctggaaaaagcttggccagggccacatgggacaaccggggaaggaggtcctgtggccactctatccaagccttccctaggtgaccgctccaaaatttccaaggacgtttatgagaacttccgtcagtggcagcgttacaaagccttggcccggaggcacctatcccagagtcctgacacagaagctgtgaaggagtatgttgacatcatggaatggctggtggggactcacttggccactggggagtcagatggaaaacaagaggaagaagggcagcagcaggaggaggaagggatgtatccagatccaggtctcctgagctacatcaatgagctgtgttctcagaaggtctttgtctccaaggtggaggctgtcattcaccctcaatttctggcagatctgctgtccccagaaaaacagagagatcccttggccttaattgaggagctagagcaagaagaaggactcactcttgcccagctggtccagaagcgactcatggccttggaagaggaggaagatgcagaggcgcctccaagtttcagtggcgctcagttggactcaagtccttctggttctgttgaggatgaagatggggatgggcggcttcggccctcacctgggcttcagggggctgggggcgccgcttgccttggaaaggtttcttcttcaggaaaacgggcaagagaagtgcatggtgggcaggagcaagccctagatagccccagagggatgcacagggatgggaacactctgccatcccccagcagctgggacctgcccaccaatggagaatcccaatgttga

SEQ ID NO: 1354 - DNA, 1382 bp, Homo sapiens
gctcaggccccgccctcagacgagcaccgcccgccggctcctcccgcggctcgaatcgccgtctctctcctccccgccccgccgagttctagaattcgccgcgcagctgcttcagcccctcagccccagccggaccctcgggtcctcatccaccctcgcaggcgcaggccgtggctaccccgaagtcaactgtggaggatccttcctggcttccttcagctccatcctgcccttggatctaggtcacccgcttggacccaactatctgaggcccgaatgccccgcagctcccgctgctccctcgcgttctgctgacccccctccgagtcaggacatcccctttagaccccactttaggccctttcagcccaactccaactagccccatctgccgcttccgcacgcaccaaaaaggagactaactacccagccccgtccagtcatgcaggtgcaggatgatggagtcaacctcatcccctttgccaagtgttccagggtggtcagccgatctccacccccaaggttgccttcccagagcctcagacccatgccccagcgttatggagatgtcttctggaagaaccttaatcaaaggcccacccccacttggctggaggagcagcacattccacccatgctgctcccaccccctgaaatgctttggagaagaaagaagaggaggccatgtttggaaggaatgcagcagcagggccttgggggagtccccgcccgggtgagggctgtcacttaccacctggaggacctaagaaggcgtcagagcatcatcaacgaactgaagaaggcccagtggggcagctctggggctgcatctgagccagtggtgcttggcgaagagggctgtggattccccagcaccaatgaataccctgatctggaagaggagagagcaacctatccacaggaagaggaccgttttctcactcctggcagggcccagctgctttggtctccctggagccccctggatcaggaggaggcttgtgcctccaggcagctgcactctctggcctcgttcagcactgtcacagccagaaggaacccccttcacaatccctgggggatggagttggcagcgtctgaagagtaaggagaaaccaccgatgccgagaggctagtggtgccccagggacccaagactagttccgtcactagagtcaccctcattgctgacatgaaggcgtttccccttccttcgtctctccaactgcctttcccatcctctgaactaggcattaacagcccccgtgggctcccatctcaacccaccgctctcacaggagcaccccaagtcctgttttcctccaggccccgctcctggccttgtattctctctgctctgttattaaaaagcaagcaagtgg

SEQ ID NO: 1355 - DNA, 616 bp, Homo sapiens
agcggagctgagctcgggtaggccgcgcgaggtccctcctctccgggcgtccgtgcgcctagctctgcgctgggagcctcgcgccctttgacagcagttagttgctgactcggatgcagagagtcggtaacaccttctccaacgagagccgggtggcatcccggtgtcccagcgtgggccttgctgaacggaaccgggtggccacaatgccggtgcggctgctcagggacagtccagcggctcaggaggacaatgaccatgccagagacggtttccaaatgaagctggatgcccacggcttcgccccggaggaactggtggtgcaggtggatggccaatggctgatggtgaccggacagcagcaactggacgtcagggacccggaaagggtcagttaccgcatgtcacagaaggtgcaccggaaaatgctcccgtccaacctgagtcctaccgccatgacctgctgcctgaccccctccgggcagctgtgggtcagaggccagtgtgtggcgctggccctccctgaagcccaaacaggaccgtccccgagactcgggagcctcggctctaaggcttccaacctgacccggtaaacaaacgacgcgatgtgcagcag

SEQ ID NO: 1356 - DNA, 2674 bp, Homo sapiens
ctgctttgtctgctgtcccctctctgctggagaacttagcccagagctagtgaacgagcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccccagctacgcaggctcactgcccacgtccagctcctactccagcttcagcgccacgtcggaggagaaggagcacgcgcaggccagcacgctgaccgcgtcgcagcaggccatctacctgaacagccgcgacgagctcttcgaccgcaagccacccgccaccacctacgagggcagccctcgctttgccaaggccacggccgcggtggcggccccgctggaggccgaagtggccccaggcttcgggcggaccatgtcaccgtacccggccgagaccttccgcttcccggcctctccgggtccccagcaggccctgatgcccccaaacctgtggagcctgcgggccaagccggggaccgcccggctccccggggaggacatgaggggccagtggcgtcccctgagcgtggaggacatcggcgcctactcctaccccgtgagcgctgccggccgcgcctcaccctgcagcttctctgaacgctactacggcggggccgggggcagcccgggcaagaaggccgacggccgcgccagcccgctctacgccagctacaaggccgacagcttctccgagggggacgacctctcccagggccacctggcagagccctgcttcctgcgggcgggcggcgacctgagcctcagtcccggccgctcggctgacccactgcccggctatgcacccagcgaggggggggacggggacaggctcggggtgcagctgtgtgggaccgccagcagccctgagcccgagcagggttccagggactccttggagccgagctccatggaggcctccccggaaatgcatcctgccgcccgcctcagcccccagcaggcctttccgcggactggtggctcggggctgagccgcaaggacagcctcaccaaggcccagctctacggaaccttgctcaactgagcgcctgcgtgcaggcctggccgtggttcgctccccgccagcccacgtgccccagaagggccggcctcacctctccccagcccccgctgttcccctgccccggccaacaacgaggagtctgttcctccccgcacctcctctcctccccagccctgtaggcctgaggggagggtcccccacaccacggtgtccacccggccccggcccgtggaactccacttagagcgtttttcacgcgtccttcccccatgtgagaggagcatccccccttttataaagcgaaactatttttatagagaaaaagggtctttcttaacgcacttggcctccagctccctggacggctgccttggcgttttcaacacaaagctcctttattttttgggcgagggtgcgtggggcctgccccttggaagggaagggaaggacggtgtcctgtggagaccagactctgcaagtggggagaccacccccgcaagccagtgacaagggagccctgaagttgtgtccacgaagagggagctgaaacaaattcggggctatgaagtgttttaaaaatccattcttcgcagtgtggccaccacaccgccctgagccctcccacggcccatcgtcccgggtgggccgggatgatgccccagtgcggccggtgctcatctccgcccccgggtccgccccctgacaccgtcttactctacctcagacatgaggaggccctccattcctggtttctgtagcttgcattcttgttgtctctgatgcatgccctgccagttagtactgtattttgcattcattaataaaagacaccggtggaaag

SEQ ID NO: 1357 - DNA, 3280 bp, Homo sapiens
agccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcagggactttctccctcgagggtcgggcattgtaacaagacgacctcttgtgctgcagcttgttacttctaaagcagaatatgccgagtttctacattgcaaaggaaagaaatttacagattttgatgaagttcgccttgagattgaagcagaaacagatcgcgtgactggaatgaataaaggcatttcctccatacccattaatttacgagtctattccccacacgtgttaaatctaacccttattgatctacctggaataactaaagtgcctgtgggagatcagccaccagatatcgagtatcagatcagagaaatgattatgcagttcatcacgagggagaactgtctgattttagctgttactccagccaacactgatcttgcaaactcagatgcgctgaagctagctaaagaagttgatcctcaaggtctgagaaccattggagttatcaccaaactggaccttatggatgaaggaacggatgccagggatgttctagagaacaaactgttgcctcttcgcaggggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagatggttcagcaatttgctgtggactttgagaagagaattgaagggtcaggggatcaagtagataccctggaactctcaggtggtgctaaaatcaatcgtatttttcatgaacgctttccttttgagatagtaaagatggagttcaatgagaaagaattgcgaagagaaataagctatgcaatcaaaaacatacatggtatcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaactggcaaacttccccagactctgcgaggaaacggaaaggattgttgctaaccacattcgtgagcgagaagggaagacaaaggaccaggtattgctattgattgacattcaagtctcttacatcaacaccaaccatgaagacttcattggcttcgcaaatgctcagcagaggagcagtcaggttcacaagaaaaccacagttggaaatcagggaaccaatcttccgccttcaaggcaaattgtgattcgcaaggggtggctcaccatcagcaacattggcatcatgaaaggcggctcgaagggatactggttcgtccttactgcggaaagcttgtcctggtataaagatgatgaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacagccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaagccggagaccacccccatcaccaactcgtcccactataatccgcccactagaatcctccctgttagactaaacgaagtgtctggcatggcaattaatcactaatgaattatgcgaaagcaacatatttgataaccgttgcagtaaatcatgagtagtcgcatgtgtggacatcagtaggcaagtaaccagttttactaatgcattcatcgctcatcttcattgctcatggtatgtcaaacctttggggtttgactcagaaactgctaaccttttagaggctttatatgttgtactgaccaaggtaggtttgtatagcagccctatactttggggatcatttgcctaccatggcatatatttgaaattgctttggacaagttttctaggctatctaccaggtagctcattaaacgtaattcttcagatatgagatagtgggcttagacctaagccatacatatttcttttcccacattctgtttaggatgacagtaattctgttgtctaccattaatgctactacctactccataattgcctatttagctcctcttttcttcctttttatttcataagactgcta

SEQ ID NO: 1358 - DNA, 3941 bp, Homo sapiens
attgcgtcccgctctacctctgtggttctttgggagcgacccccgggaagcgtccaaagtggagttcccacacacgctgcgaacccacagccggttttctctgaactcgcgtccctgagtccgggaggtggaggcggagaaaagggtgcggagcgaccccacgcagggccgccccccctcccaccagcgcgtcctgccgcgccggcagccacaggctggcatagcggctgccgacccgccctcgttcctccaccccctgaacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttcccatt

SEQ ID NO: 1359 - DNA, 3099 bp, Homo sapiens
tgcgtgcgtgtgtgtgtgcgcgcgtgtgtgtgtctccgagtccctgggagagtggaggctcattcactgattagatccagcgctgagaggcagcactgctccttctctcacgccaactgagtctcttgatctgtacatgcaatcccaggcagctcgcgaacacaaacccggggccagccgcctactgctgctgctgctgctgccgctgccgccgccgccgccgccgctgcctccgccggctctgcgaacccgggacttttcatgcaccacactctccgcctgcttccctccgtgtcctgaaaagtgcgaccgttctcccaaggaatttccacggtcttaggagggaatgattccccagtaatattccctgccctgacccaaagtgctggttggcctccctcccagggaagactgcttcttgcgtaacgccggccacagaaagagactccgatggacttacaccgggcagccttcaagatggagaactcatcctaccttcccaaccctctggcatccccagcactgatggtcctggcatccacggctgaggccagccgtgatgcttccatcccttgtcagcagccacgaccctttggtgtacctgtctcagttgacaaggacgtgcatattcctttcaccaacggttcctatacctttgcctctatgtaccatcggcaaggtggggtgccaggcacttttgccaatcgtgatttccccccttctctactacacctccaccctcaatttgctcccccaaatctagattgcaccccaatcagtatgctgaatcatagtggtgtgggggctttccggccctttgcctccaccgaggaccgggagagctatcagtcagcctttacgccggccaagcgacttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatctagcccagaggatcggaatgacagatgtaagaagaaagcagcggcattgttcgacagccaggccccaatttgccccatctgccaggtcctgctgaggcccagtgagctgcaggagcatatggagcaggaactggagcagctagcccaactgccctcgagcaagaattcccttctgaaggatgccatggctccaggcaccccaaagtccctcctgttgtctgcttccatcaagagggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 1360 - DNA, 2561 bp, Homo sapiens
tgtctgatgatgctggtgacaccttagccactggagacaaagcagaagttactgaaaacggagtccctgaaagtgagtgaaagcccacccacttccccttcatcagcctctcggggtatgctgtctgccatcaccaatgtggttcaaaacacaggtaaaagtgtcttaactggaggccttgatgcgttggaattcatcggcaagaaaaccatgaatgtccttgcagaaagtgacccgggctttaagcggaccaagacgctcatggagagaactgtttccttgtctcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggttcagtcatttttagcatcacttgatggagagaagctggaactcttaaaaaatgacctaatttccattaaagacatctttgcagccaaagaattagagaatgaagaaaatcaagaagaacaaggcttagaagaaaagggagaagaatttgctcgcatgcttacagagcttctctttgaattacatgtggcggccacacctgacaaactcaataaggccatgaagagggctcatgactgggtggaagaggatcaaaccgtggtgtcagtagatgtggcaaaagtgtccgaagaagaaacaaagaaggaagaaaaggaagagaaatctcaagaccctcaagaagacaaaaaggaggaaaagaaaactaagaccatagaggaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaaattaactactgcaatgtgcaatgaagtggcctctttatcaaagaagtttacgaattctttaaccactgttgggagcaacaagaaggccgaggtccttaaccccatgatcagtagtgtattgttagagggctgcaacagtacaacgtacatacaggatgccttccagctgctgctgcctgttctgcaggtctcacatatccagaccagttgtttgaaagcacagccgtgacctggccagactccatctagttaaaggagacagctggccgccttgcctcaatatgtaccatttaaggggatgttctctgtgcgcctggccacagacatccatttgaggacactacaagcaattttgcacagacaatattgagaatgcaaatttagagagagttatcatttctctcaatgtgtataattgtttttacaaacaattgtgttttctttatgttaatttaaacttacacagcttatattgaaaatttcctttcatctgaaatttatttacaaatattcgtgttcattttcctggttaagcatgctatatttagaaactcatggggagaccttagacttttgtttaatcctttatgtttcaacctttaaatgttccattcttatagtattactttaaatcaattctaaaactgaactttgttttgttacataaatgtcgcaggcaaaaataacactacttatagattttacctattatggtaaaaaataggaacatattgtcattctttttttttttttttttttgagacagagtctcactctgtcgccaggctggagtgcgttggcacaatctcggctcactgcaacctccgcctcctgggttcaatcgattctcctgcctcagcctcctgagtagctgggactacaggtgtgtgccaccacgcccagccaattttttttgtatttttagtagagacagggtttcaccatgttggccaggatggtctcgatctcctgacctcgtgatctgcccgcctcagcctcccaaagtgctgggattacaggcttgagccaccgcgcccggccggtcattcattcttgcaacaagcatttattgagcacctactgtgtgctcacagtaaagaaacgtgatcttatcccagtagaggtagatattctgaaaaagaataattcttaaactgcttaaaacaggggtccccacccccaggccacagaccagtaccagtccgtggcactggttaggaaccaggccacacagcagggggtgagcggtgggtgagtgagcacagcttcatctgtatttacagctgctccccagagcttgcattactgcctgagctctgcctcccgtcaggtcagcagcagcattagagtctcatgggagtgcgaaccctgttgtgaactgcacatgcgagggatctaggttgtgcactccttatgagaatctaatgcctgatgaatctaatgcctcatgatctgaggttgaatagcttcgtgccgaaaccatcccccacccccatcccgctaccccgagtccgtgaaaaaattgtcttccatgaaaccggtccctggtaccagaaaggttggggaccactggcttaaaataccaataaatttttgaacctt

SEQ ID NO: 1361 - DNA, 745 bp, Homo sapiens
atctcccatcaacatgtcctacaactgctgctctggaaacttctcctcccgctcctgtggtggctacctgcactacccagcctcctcctgtggcttttcctaccccagcaaccaggtctacagcactgacctctgctctcccagcacgtgccagctgggttcctctctctataggggctgtcagcagacctgctgggagcccaccagctgccagacatcctatgtggagtccagcccctgccagacctcctgctaccgtcccagaacctccttgctctgcagtccctgccagacaacttactctgggtctctaggctttggatccagcagctgccgctccctgggctatggatcgaggagctgctactcagtgggctgtgggtccagtggcttcagatccctgggttatggaggctgtggcttcccttccctgggctatggcgttggattctgccgcccaacctacttggcttctaggagctgccagtcttcttgctacagaccaacttgtggatcaggcttctactattgatcatcttgttaaattgctgattttgttggctaatgccttcaatgcctctactcataacctttattgtcttcatcatgtacagaaagaattagcctcttattctataattatcaagttctcagtttgtctttgtccccaaatactggctggcaggcttcatctgaaaaactgtaattggagaactagctcaaaataaatcttgaaatacacatt

SEQ ID NO: 1362 - DNA, 2663 bp, Homo sapiens
ggaggagagaagaggaggtggagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 1363 - DNA, 2218 bp, Homo sapiens
caggctgggttccagcatagggctcttggtgggcacgctggggtcgggtggaatgcaggagagagaggaggtgggacaggtgggtacctgggctggaggcagggcctgaggtgggcaggtgcagagggctgcacttctcggctgaagccgggaatgaggaccccgctctcgggtgggattggaggggacccgcggctgaggcgctgggctgcgacagggacatcaccgttctcctcctcagggagatggtgctcgtcgtgcacggcttcccgtcctccgtggccgcccttcgggtaaggaaggagaccgggcagcggcggccgggtgagggcttgggttccgcccctcgctccgagccgccctgatgcccctgtacgccgcccgcagtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggatgaagaggggcccttgtgttgcccccaccctggctgcctgctaagggcccatgtgatctgcctggcagaggagtttcttcaggaagaaccagggcagcttctgcccctagagggccaatgcccttgctgtgagaagtcactgctttggggagacctgatctggctgtgccagatggacactgagaaagaagtagaagactcagaattagaagaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaatt

SEQ ID NO: 1364 - DNA, 1696 bp, Homo sapiens
cacagacctggaacaaactaaagccagacacatactatggacaccaagggctgtacaacaaccaattctccttcaaccccatgtcaaaactgctctaggattacaaatgttagtaccatctcttctaacaacggctgccatcctggtggccttacagtcaacaactgtcaaccagctggccacgttctcagaattccctgggaccagggctgccaacccactcctcgcttttgtcgcaagcccatctacctaatgaacaacttcaatgcccgtttttctctggatgactgcagctggtatggtgaaggcatcaacagtaatgagaaggagaccatgcaaatcttgaacgagcgccttgctaactacctgcaaaaggtgcgaatgctagaacgagagaatgctgaactggaatctaaaatccaggaagaaagtaacaaagagctccctgttctatgtcctgattacctgtcttactacactaccattgaggagctccagcagaagatcttgtgtaccaaggccgagaattccagactggtctcgcaaattgacaacaccaaactgactgcagatgacttgagagccaaatacgaagctgaggtgtctctacgccagctggtagagtcagatgccaatggcctcaagcagatcctgaatgtgctgaccctgggcaaggccgacctagaggcacaagtccagtctctgaaagaggagctcctttgcctcaagaacaaccacaaagaggaaatcaattctttacagtgtcagcttggggagagacttgacattgaagtgactgctgccccttctgctgacctaaaccaggttctacaagaaatgagatgtcaatatgagcccatcatggagacaaaccgcaaagatgtggaacagtggttcaacacgcagatagaggagctgaatcaacaagtggtgaccagctctcaacagcagcaatgctgccaaaaggagatcatagaactgagacgcagtgtgaacactctggaggttgaactgcaggcccagcatcgaatgagagattcccaagagtgcatcctaacggagacagaggctcgctacacggccttgctgacccagatccagagtctgattgataacctggaagctcagctggcagagatccggtgtgccctggaaagacagaaccaagaatacgagatcctgctggacgtcaagtcccggctggaatgtgagattaccacataccgcagccttctggagagctcggatggcaagcgtccctgttacccacgtgccaccaaatgtgagccttccccttggacatcttgtaagtccggagccatagaaagcacggccccagcttgcacatcctcatccccctgcagcttaaaggagcactgcagtgcctgcggacccctgtcccggatactggttaaaatttgcaccatcaccaaggagattaaggatgggaaggtcatttcttcttacgagcatgtgcagccttgtttcatcatcagacctgccaaagtctaacatcccaaggtgatgaaaatgacccacatttatgaaacagaggccaatacatgctcctgccagagaggtttaagaaaactccccagtcccttaaggtacttagtttcttactactacagcgggtccccattgctaggtagaatatcttttattctgctccttccctaactcaccactgctaaca

SEQ ID NO: 1365 - DNA, 3503 bp, Homo sapiens
gtttgtggcccaggtgcaggaagcttacgcggtggcagccgctcgctgaggtagtctctcgcggcgccggggatccctgaacacagacagcgcgggactgagaaggaaagcttctttctgggcagccagagccgcaaaggtggagccgcgttggcgccctccgcgggaccagcgcctcggatgcgggcggagcgcggggggccgcggctgcgggagcgcgaagcggggggccaggggcgcctcatgtgagagccgcgggacctgcagccgccgccgtccccggagcacggggtggtgtgtgggggaagccgcccccggcagcaggatgaaacgaggaggaagagatagtgaccgtaattcatcagaagaaggaactgcagagaaatccaagaaactgaggactacaaatgagcattctcagacttgtgattggggtaatctccttcaggacattattctccaagtatttaaatatttgcctcttcttgaccgggctcatgcttcacaagtttgccgcaactggaaccaggtatttcacatgcctgacttgtggagatgttttgaatttgaactgaatcagccagctacatcttatttgaaagctacccatccagagctgatcaaacagattattaaaagacattcaaaccatctacaatatgtcagcttcaaggtggacagcagcaaggaatcagctgaagcagcttgtgatatactatcgcaacttgtgaattgctctttaaaaacacttggacttatttcaactgctcgaccaagctttatggatttaccaaagtctcactttatctctgcactgacagttgtgttcgtaaactccaaatccctgtcttcgcttaagatagatgatactccagtagatgatccatctctcaaagtactagtggccaacaatagtgatacactcaagctgttgaaaatgagcagctgtcctcatgtctctccagcaggtatcctttgtgtggctgatcagtgtcacggcttaagagaactagccctgaactaccacttattgagtgatgagttgttacttgcattgtcttctgaaaaacatgttcgattagaacatttgcgcattgatgtagtcagtgagaatcctggacagacacacttccatactattcagaagagtagctgggatgctttcatcagacattcacccaaagtgaacttagtgatgtatttttttttatatgaagaagaatttgaccccttctttcgctatgaaatacctgccacccatctgtactttgggagatcagtaagcaaagatgtgcttggccgtgtgggaatgacatgccctagactggttgaactagtagtgtgtgcaaatggattacggccacttgatgaagagttaattcgcattgcagaacgttgcaaaaatttgtcagctattggactaggggaatgtgaagtctcatgtagtgcctttgttgagtttgtgaagatgtgtggtggccgcctatctcaattatccattatggaagaagtactaattcctgaccaaaagtatagtttggagcagattcactgggaagtgtccaagcatcttggtagggtgtggtttcccgacatgatgcccacttggtaaaaactgcatgatgaatagcaccttaatttcaagcaaatgtattataattaaagttttatttgctgtagttctgatataattctactattttgtggcacagaaatttgatatcttcagtcagtatatgtaaagattgtttatcggaagacccatgaatgagttttggtcagaaaattccacttgtttccttagtgtaatagcagtcatatctccgaattttttttaatgtggttcggatgtgaaataaccagttatacgtattaaacagtttacagtctaaaggaaacaaaacctatatgttataatatccaagaagtactaataggttttctgaaatgttatattctctatgcatttaaaaaaaaatgtaaacttgacattttagggtcttcagttacacatacacctgttataaggtgtttaatatagctcaggaaagtgagcattttgtgagaaaaatgaatatatcatatctaatggaaaagattggatgaatgttctcaaatgttacaaagctgtttaaagaaaaaggtatatataagtaatcagaacacttagaagactgatagatgtcacacagtggtattatagaaggataatacagagccaagatcaaattaaaagacaataaatggaacagaagggaggcagtgtttagctttgtataaacttttaggtttgctctgtaatctgctaaaccatatacattcttttgtgatatgttattatgtatgtggcacttgaggcactgtatgtaaagtaaggaatgctttactagttctccttggttttatctttgtttaaactagctttaaagtattaaacaataattgaaatgaaaagcttacctattttaaaaagccaaatttaaataaatatagaactttaaaatgtttatcagttgtttccatgaaagaatattagtttccagtaaattttagtgatggctcactcacttttctattttggaattacatagttatgtaagtaaaatttttaaaaatcataaagggagcaccattgtacagtctagcataaacagcaaattttaaagaggacatatttaagttcataatcatatttttcagtaaatattgctcagtgaactggaaaactttaatagaaaaatgtctgcagttttgtgattgttaatttggttaaaccgatattttatattatttaagttaggtaacattttatattactttcatatgaataaaagtaatccatgcattgtagagtctataaaatgttgagttttaaaagatgatataaactttgatgctgggcactagtgctagtagatattactaccctcctgagggaaatcagaaatgatttaaccccggtggaatacattaattcttaaagcggctcttttcagtggtgtgacttttagattgtgtctcagtggttgaggaagctaacagtcttagatctacttttaaaacggatggccttcttaagaataaagcaaaaggtgattttctacataatttttgctttccaaaagtgatgatatgctctcctacagcaacatatgagaagaaaaaaggcttatctagattcgaaaattaacagcaattatagtaatatatcccctccttctaaatagtaaaaagctctgattgtacaagaattacctgtgctagtcaagttgttgtttttccttgaacaactttggaaaaatggatttgacagtacataatcagttctactaaccaaagcttgtatttggaaatttactttttgtacaaattgaattatataatgcttaaaatactttgtcactttataagcaaaatgcatagtacttaatttgtttatactgtaaagtatatgttaaatgcttttatcactttgagaataaaaagttactaatgctgttgta

SEQ ID NO: 1366 - DNA, 4622 bp, Homo sapiens
ttttattacgtctctccttgtggattacgtagaactttggaaaattaaacattagacatcttcatagaaaatcatgtcactgatttttaaagccagctcaatttaacctgccactgattccctaaccagctcttctctgactgtatcccgagggaaaatgtattgaacgcagcagaaggttaaggcagaggagttcggctagaccgggtagcagccaatcagatggggagggtccaaggatctgatgcctccaggcgagcagcgccaagctgagctggttagtctccttttattgtggatgaacaccacgtacatgccgtaaatgctccctaggctggctgcggctacaaggcagacccgggagctgagaatagaggaatacctgcccaagcaactcattctgcacagcagccgacaagacagcgattttcctgtgctggaatgtgcccatccaaagccaaccaatttgttggaaaatcagtcaaaatctaattttgatgttctgcaagttccctgggggccatgaagcacctgacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaaggtggggatgatagcaaaatatgtccatccctttgcagttactcagggctcaacggcaacccctccagtgagttagattactgtagcacttacagacagcacttggatgtccctcgggactcaccaagagccattagtttcaagaacggctggcaaatggcccggcaaaacgcagaaatctggagcagcacggaagaaaccgtctctcccaaaatcaaatcccggagctgtgacgatctcctaaacgacgactgcgatagcttcccggacccgaaagtcaagtcggaaagcatgggctccctgttatgtgaggaggactccaaggagagctgccccatggcgtgggggtccccctacgtcccggaggttcgcagtaacggcagatcaaggatcagacacaggtcagcccgcaacgccccggggttcctgaagatgtacaagaaaatgcaccgcatcaaccgcaaggacctgatgaactccgaggtgatctgctccgtgaagtccaggattctgcagtacgagagcgagcagcagcacaaggacctgctgcgcgcctggagccagtgctccacggaggaggtgccccgggacatggtgcccacacgcatctccgaattcgaaaagctgatccagaagtccaaatccatgccaaatttaggggatgacatgctgtctcccgtaaccctagaaccaccgcaaaatggcctatgtcccaagaggcggttttccattgagtatttgctggaggaagaaaatcaaagcggcccccccgctcggggccggcgaggctgccagtctaacgccctggtgcccattcacattgaagtcaccagcgatgagcagccccgagcacacgtggagttttccgacagcgaccaggacggggttgtgtccgaccacagtgactacattcacctagaggggtcatccttctgcagtgaaagtgactttgatcacttttccttcacatcctccgaaagcttttacggatccagccaccaccaccaccatcaccaccaccaccaccaccgccacctcatcagctcctgcaaaggcaggtgcccggcctcctacactcgatttaccacaatgttaaaacacgaaagagccagacacgaaaacaccgaggagcccagaaggcaagaaatggaccctggcctttctaaacttgcttttctagtcagtcctgtgcctttccggaggaaaaaaaattcggctcctaagaaacagactgaaaaggcaaaatgtaaagcatctgtgtttgaggctctggactctgcccttaaagacatctgtgaccaaattaaagctgaaaagaaaagggggagcttgccggacaacagcatcctgcaccgcctcatcagtgagctgctgccagatgttcccgagaggaactcatccctgagagcgctgaggaggagccccctgcaccagcctctccacccactgcctcccgatggtgctattcattgtccaccctaccagaatgactgcgggagaatgccccgcagtgcctctttccaagacgtggacacagccaacagcagctgccaccaccaagaccgtggcggtgcactccaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggc

SEQ ID NO: 1367 - DNA, 1950 bp, Homo sapiens
gcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgaccttgcctcatagtattcgatcagattcagaagatatctgtttatttacgaaggatgaacccaattcaactcctgaaaagacagaacagttttatagaaagcttttaaacaagcatggaattaaaaccgtttctcagattatctccctccaaactctaaagaaggaatataaatcctatgaagccaagctccgccttctgagcagttttgatttcttccttactgatgccagaattaggcggctcttaccctcactcattgggagacatttctatcaaagaaagaaagttccagtatctgtaaaccttctgtccaagaatttatcaagagagatcaatgactgtataggtggaacagtcttaaacatttctaaaagtggttcttgcagtgctatacgtattggtcacgttggaatgcaaattgagcacatcattgaaaacattgttgctgtcaccaaaggactttcagaaaaattgccagagtgggagagcgtgaaactcctgtttgtgaaaactgagaaatcggctgcacttcccatcttttcctcgtttgtcagcaattgggatgaagccaccaaaagatctttgcttaataagaagaaaaaagaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctga

SEQ ID NO: 1368 - DNA, 3290 bp, Homo sapiens
ggtgcttgccctgcccatccccgtggcgggggcgtggccatggcgggggcgctccggcgggggcgggccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggacgttg

SEQ ID NO: 1369 - DNA, 1602 bp, Homo sapiens
cggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaa

SEQ ID NO: 1370 - DNA, 2015 bp, Homo sapiens
gtcaaacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccaggaa

SEQ ID NO: 1371 - DNA, 1720 bp, Homo sapiens
cgcgccgcttccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctcccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttgg

SEQ ID NO: 1372 - DNA, 2670 bp, Homo sapiens
gctcgcaggcgggggtttccatggtgatggtcaacaagcctcaactgcctctgctacaactgccaagttccccgcgtcccaccctcctctaggtgctccaagggaccaccggggtgcctgatatgagagcgggagtgtagagactcggaggccgaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaactttt

SEQ ID NO: 1373 - DNA, 1302 bp, Homo sapiens
ctggttctggaggctgggttgagaggtcgccggtccgactgtcctcggcggttggtcagtgtgaatttgtgacagctgcagttgctccccgcccccgagcagccgaggtgcgtgggggaaggggaagaaggaaaaggtccgggtcgcgtttccgctcagtttttgccagggttgaggcgattccagagagcggcggaaaggataagcctcgacttagaagctaccgagttaccctaagaaaggagtctaccatggctcaagaatctcccaaaaattcagcagcagaaattccagtgactagtaatggagaagttgatgactctcgtgaacatagctttaatagggatttgaagcattcattaccatctggacttggtctctcagaaacccaaattacatctcatggctttgacaataccaaagagggtgttattgaagcaggagcatttcaaggtggccagagaacacagacaaaaagtggaccagttattctagcagatgaaattaaaaatcctgcaatggaaaagttagaacttgttagaaaatggagtctaaacacctataagtgtactcgacagattatctctgagaagctaggccgtggctcaagaactgtggaccttgaacttgaagctcagattgatatattaagggataacaagaaaaaatatgaaaatattttaaaactggctcaaacattgtcgacccagcttttccagatggtacatacccaaaggcaacttggagatgcatttgctgacctgagtttgaagtcactagaacttcatgaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgaagaacagtaaaatcacagcggaaaataaaaagaaa

SEQ ID NO: 1374 - DNA, 2378 bp, Homo sapiens
tggaggccgggcgcgcgggccctactcggcagggcctgctcggggccggcttcgggcctgcccggccgggcctgcccgcacccttccgcccggcctggccggcgccccctcgcgccccgggcgggccctgcacgtctcgcgagcagcccggagcggcgggggaggcggggcccgcgggctgccgggcagggccggggcggtgccgaggccgggccggagcggggcgaagggggccgagcggcgggccgggccgggccgggcagggccggggcgtgggccggcaggaagatggcgaacgtggggctgcagttccaggcgagcgcgggggactcggacccacagagccggcccctgctgctgctcgggcagctgcaccacctgcaccgcgtgccctggagccacgtccgcgggaagctgcagccccgggtcaccgaggagctctggcaggctgccctgagcacgctcaaccccaaccccacggacagctgtcccctctacctgaactacgccaccgtggctgccctgccctgcagggtgagccggcacaacagcccctcggccgcccacttcatcacgcggctggtgcggacctgcctgccgcccggagcgcatcgctgcattgtgatggtctgcgagcagccggaggtctttgcttccgcctgtgccctggcccgggccttcccgctgttcacccaccgctcaggtgcctctcggcgcttggagaagaagacggtcaccgtggagtttttcctggtgggacaagacaacgggccggtggaggtgtccacattgcagtgcttagcgaatgccacagacggcgtgcggctagcagcccgcatcgtggacacaccctgcaatgagatgaacaccgacaccttcctcgaggagattaacaaagttggaaaggagctggggatcatcccaaccatcatccgggatgaggaactgaagacgagaggatttggaggaatctatggggttggcaaagccgccctgcatcccccagccctggccgtcctcagccacaccccagatggagccacgcagaccatcgcctgggtgggcaaaggcatcgtctatgacactggaggcctcagcatcaaagggaagactaccatgccggggatgaagcgagactgcgggggtgctgcggccgtcctgggggccttcagagccgcaatcaagcagggtttcaaagacaacctccacgctgtgttctgcttggctgagaactcggtggggcccaatgcgacaaggccagatgacatccacctgctgtactcagggaagacggtggaaatcaacaacacggatgccgagggcaggctggtgctggcagatggcgtgtcctatgcttgcaaggacctgggggccgacatcatcctggacatggccaccctgaccggggctcagggcattgccacagggaagtaccacgccgcggtgctcaccaacagcgctgagtgggaggccgcctgtgtgaaggcgggcaggaagtgtggggacctggtgcacccgctggtctactgccccgagctgcacttcagcgagttcacctcagctgtggcggacatgaagaactcagtggcggaccgagacaacagccccagctcctgtgctggcctcttcatcgcctcacacatcggcttcgactggcccggagtctgggtccacctggacattgctgcaccggtgcatgctggtgagcgagccacaggcttcggtgtggccctcctgctggcgctcttcggccgtgcctctgaggaccctctgctgaacctggtgtccccactgggctgtgaggtggatgtcgaggagggggacctggggagggactccaagagacgcaggcttgtgtgagcctcctgcctcggccctgacaaacggggatcttttacctcactttgcactgattaattttaagcaattgaaagattgcccttcatatgggttttggtttgtctttctggtcgtcagcgtggtggtggaaacagctgaagttttaggagacagcttagggtttggtgcgggccacggggaggggaccgggaagcgctggggcttgtttctgtttgttacttacaggactgagacatcttctgtaaactgctacccctggggccttctgcaccccggggtgaggcctcctgcctgcctggtgccctgtcccagccccaggtcctgtgcagggcacctgcgtggctgacagccaggctcttactccagccggggctgccagcgcatccagccagcccagccctgtgaaagatggagctgacttgctgcaggggacctgatttatagggcaagagaagtcacactccggcctctcagaattcacttgaggttcaattaaatacagtcacaccgccccctca

SEQ ID NO: 1375 - DNA, 4406 bp, Homo sapiens
gcgtgggctcccgatgggctgcctgagcgggtgcgcgggcaacttccggtgtgggtgacgagtggtggccgaagcagggggacagcaagggacgctcaggcggggaccatggcggacggcggctcggagcgggctgacgggcgcatcgtcaagatggaggtggactacagcgccacggtggatcagcgcctacccgagtgtgcgaagctagccaaggaaggaagacttcaagaagtcattgaaacccttctctctctggaaaagcagactcgtactgcttccgatatggtatcgacatcccgtatcttagttgcagtagtgaagatgtgctatgaggctaaagaatgggatttacttaatgaaaatattatgcttttgtccaaaaggcggagtcagttaaaacaagctgttgccaaaatggttcaacagtgctgtacttatgttgaggaaatcacagaccttcctatcaaacttcgattaattgatactctacgaatggttaccgaaggcaagatttatgttgaaattgagcgtgcgcgactgactaaaacattagcaactataaaagaacaaaatggtgatgtgaaagaggcagcctccattttacaggagttacaggtggaaacctacgggtcaatggaaaagaaagagcgagtggaatttattttggagcaaatgaggctctgcctagctgtgaaggattacattcgaacacaaatcatcagcaagaaaattaacaccaaatttttccaggaagaaaatacagagaaattaaagttgaagtactataatttaatgattcagctggatcaacatgagggatcctatttgtctatttgtaagcactacagagcaatatatgatactccctgtatacaggcagaaagtgaaaaatggcagcaggctctgaagagtgttgtactctatgttatcctggctccttttgacaatgaacagtcagatttggttcaccgaataagtggtgacaagaagttagaagaaattcccaaatacaaggatcttttaaagctttttaccacaatggagttgatgcgttggtccacacttgttgaggactatggaatggaattaagaaaaggttcccttgagagtcctgcaacggatgtttttggttctacagaggaaggtgaaaaaaggtggaaagacttgaagaacagagttgttgaacataatattagaataatggccaagtattatactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacatatttcctttctacagttacctctgattctcaacattttgtggggtagtgatttggcaagtgttttttaaataaaacaaatctcattgtaaagctatcagtcatttagtagaatagaaaagcaacatagagcatacaagaacatttgggatagagttgtgatttgtgaagaatttgtactttgatattgtggcggaaagtctagactgagtgtgtatgctggtaaactgtagacttttttttttttttttttgagtccggctggttccaatcacagtagcttgattgctttcagccctcatcctctcacttgatcagttgttcaacagaatcagctgacataattgacacagtttattgggtgttaagtccgctctatagggatagtgactactttttttttttttttttttttgctcttcttcctctcccctttctttatatgggtttaaatttaacataaagttgtttttataaggcttatttgtggctttaacttgtaagtctgattacatcattattgttccaaattcattatctctgtaggaacttttagttccattatatgaacactggataacctaattttttttaatgctttaaaaaaatggcaaaaagacgtcaggccaccctcatagtaagtggtgtagtattaaaatattttcacggaattaaaagtagcttgctgtcaaagaaacacctgagatgaattggtgtgaacgaattttgcaagtttaatttgatttatttcagagaaaatagaaaaaacaatgttagaaggttatttaaaatgatacttaaataaagaaagtgtgaggtctactttaaaaaaattcaaatgaagagaaaaagaaaaacagcattctagaaatggcatttctcctaattaattttccacttaatggaagattatcaattgtcctattttatgatcccaggactgaagacagttgtgggatatctgtcatatttatcctgtgagtcattgtgaataatgacatacagtactgaagtaatctgattttattctttggaaattcaatgcattggtcacactaataacatcaacatctgctatcacttatctttttaaaactaaccaaaaaaggccgggtgcagtggatcccagcactttgggaggccaaggcgggtggatcatctaaggtcaggatttcgagactagcctggccaacatggcaaaaccctgtctctactaaaaaaaatacaaaaatttgccgggcgtggtggcgtgtgcctgtagtcccagttacttgggaggctgaggtgggagaattccttgaagccaggaggcggaggttgcagtgagccaagatcacaccattgcactccagcctgggtgacagagtgagactccgtctcaaaaaaaaaaaaacaaaactggaaagttcagaaacagaagttcacactaacagagtatggttttaattttcctttgaatgaaaaggatagaagataaaattgtgtattgttaacatgtaaataaaattggagctaatttgaaactagcttctcaataacttcatctttctagagactcattacctgtgggcttgtcaaacctggactatttggccaaataggttgctatagagattgcaagtgttcctcctctttatttttttcatattttttgagacggagtttcactcttgttgcccaggctggattgcagtgtcacgatctcggctcactgcaacctttgcctcccatattcaagcagttctcctgcctcaacctcccaagtagctgggattataggcgcctgccaccacacctagctaatttttgtgtttttagtagagatggtttcatcatgttggccgggctggtctcaaactcctgacctcaggtgatccacccgccttggctgcccaaagtgctgggattacaggcatgagccactgcacccaactcctctttcgtctttctttaacacacactaggctctttgtgtattatgattcagtgctatttgtaactgtgtcccagtgaccaaattgcactcgactcgatcagctgttcatccatttcgtgttttttcctgtcaaacattaatccagcaaatatatgaggtatttaccaatttattttcttagtattacaaaataattcattagcataaagtacaatagtgaaatatttgagttgttcggaacctcaattaatcctgttttacatttcagacctaaagctggcaatcaggagaagaagcactttgttttaaatgtggagaagataacacttgattccatttcattgtcattagtgtattaaccagcaggagaggtgatgagccatttttcaaatgaaataccttttatttccatataatttttttattttagagttcaatagctgtttctatgattatcctcaatttccatatgttactgaatctgaaaaacatctttaaaattcaaacagttccattttctctcttgtaagtgttaaatgtgataaaagtacatattttaaattgttttcagctcttggatatagcagcaataaaaacactaatttgtgggtatttaagaaaacctggagaataaactcatactttaaaagatca

SEQ ID NO: 1376 - DNA, 1321 bp, Homo sapiens
gggttgggcaggcctactgactgctgcctgaaggttgctgtaaagggactaagtaaatcaattaactccacagttttcacaaaggtctcttgatatcaaaacttctttccttgcatgcttctctgatcctgtggagatgaaaattgacatccatagtcatattctaccaaaagaatggccagatctaaaaaagaggtttggctacggaggctgggtgcagctccaacaccacagcaagggagaagcaaagttgttgaaagatgggaaagtcttcagagtggtgcgagagaattgctgggatccagaagttcgtattagagaaatggaccaaaaaggagtaacagtgcaagccctttccacagttcctgtcatgtttagctactgggccaaacctgaggacactttaaacctgtgccagcttttaaacaacgaccttgccagcaccgttgtgagctaccccaggaggttcgtgggtctggggacgttgcccatgcaggcccctgagctggcggtcaaggagatggagcgctgtgtgaaagagctgggctttcccggggtccaaattggcacccacgtcaacgagtgggacctgaacgcgcaggagctctttcctgtctatgcggcagccgaaaggctgaagtgttccctgttcgtgcatccctgggacatgcagatggatggacgaatggccaaatactggctcccttggcttgtaggaatgccagcagagaccaccatagccatttgctccatgatcatgggtggagtatttgagaagtttcccaaactgaaagtgtgtttcgcacatggtggtggtgccttccccttcacagtgggaagaatctcccatggattcagcatgcgcccagatctgtgtgcccaggacaaccccatgaacccgaagaaataccttggttccttttacacagatgctttggttcatgatcctctgtccctcaagctgttaacagatgtcataggaaaggataaagtcattttgggaaccgattacccctttccactaggtgagctggaacctgggaaactaatagagtccatggaagaatttgatgaagaaacaaagaataaactcaaagccggcaatgccctggcatttttgggtcttgagagaaaacaatttgaatgactgaatttactacaaaggcaaactttcaaaaggatatctcatttttgtttctaaatatgtatcaacaggtatcaacaaaatcctattttgaactattttactcagaaatgaatgtcccaaatatcctaaattattcataataaaaatgatttgtaagtgttttcattctgaaaa

SEQ ID NO: 1377 - DNA, 2903 bp, Homo sapiens
agtaactgactacttttctcccttctctagggtcctagcacagtgtctgatggagctttcctaccagaccctgaaattcacgcatcaggcgcgggaagcgtgcgagatgaggacagaagcacgacgaaaaaatcttctcattttgatttcgcattatttaacacaagaagggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacagcagaaaataatttaccgcaaagaagtagagggaagaccagaaggatgatgaacgacagttgtcaaaatcttcccaagatcaatcagcagaggccccggtccaaaaccacagcggggaagacaggggacaccaaatcgctcaataaggagcatcctaatcaggaggtagttgataacactcgcctggaaagtgccaacttcggcctacatatatcaagaatccgtaaagacagtggagaggaaaatgcccacccacgaagaggccaaatcattgacttccaagggctgctcacagatgccatcaagggagcaaccagtgaacttgccttgaacaccttcgaccataatccagacccctcagaacgactgctgaaacctctgagtgcatttattggcatgaacagtgagatgcgagaattggcagccgtggtgagccgggacatttatctccataatccaaacataaagtggaatgacattattggacttgatgcagccaagcagttagtcaaagaagctgttgtgtatcctataaggtatccacagctatttacaggaattctttctccctggaaaggactactgctgtacggccctccaggtacaggaaagactttactggccaaagctgtggccactgaatgtaaaacaaccttctttaacatttctgcatccaccattgtcagcaaatggagaggggattcagaaaaactcgttcgggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtgggagctggactgtgccatgttacgccgcctggagaagaggattctggtcgatctccccagccgggaggccaggcaggccatgatctaccactggctgcctcctgtgagcaagagcagggccttggagctgcacacagagctggagtacagtgtgctgagccaggagactgagggctactcaggctcagatattaagctcgtctgcagggaagcagccatgcggcccgtgaggaagatctttgatgcacttgaaaatcaccagtcagaaagcagcgacttacccaggatccagttggatatagtaaccactgccgactttctggatgtgctaactcacaccaagccctccgcaaagaatctggctcagagatactcagactggcaaagagagttcgagtctgtctgaaaccacatttaccctgacctggccacaaaggcaaccacaaagacctcctagtttattaatgtccgtgggagaacaaaatgattggaatggaaaagagaaaattatttttgaagactggattaacttgagccactgtattgttttggatagctgagatatatttattaacttaccattatcgatgtcagcaaaatattgagagtttcagttacatacatatatgtgctattgggtcatacaatggagatttttctgacaattagactccataaaattttaatgaacaattttctgtaatgttactcatttgtaaactttttaagaaaaagatgtacttagaaaagttgtgttggccacacacaggatgaccctgagttggggcagccaagtagaagctaagcttgacaggcactgcccagctgacagtcccagggtgaaggaggacggaagcagggaaggcaatgcagtctgtttctcattccggacaatattctgaatctcatcagctccccctaattctgactccatccagctttgtcagcagcaaacccctcccaaactaagccccactcagaaatgtcactgagcattctgatgctagagctaatagccagggtgactagcacaccatcaccatcagctgccagtctgattgttttgggttctggcccccaataacatcttttcactcttcacacctcacatccggtgtgctctgcccttctctttccattgccgcagcttctcatcagatccaaagcttaggatggggcacctaagcttcgagaacattcatcccaagtcttccctgctcttaggctcttccccctctccttaaggggttataaacaactagacgcatctctctcagaaacccacaatccgaggcatctactttcaacccttgataaattttgaaggcttctactaagtaatgccacttcttttcccccactagaacttacctatgggaaatcaccttcttttctcttccttgccttgtcttcatcatccctgcagacagactcttcaagaggaaaaacctccagaaagagacactttggatagctaagtatcccaaaggattttacccttttaaacaaaaccaaagcatttttttcggtatcgattattttgagattattctcaaatgcctctttaaacatcatttcatggaaaatgtcaaattgaaaatataccttatttaacaaattgaaaataaaaaagatttcatctc

SEQ ID NO: 1378 - DNA, 1400 bp, Homo sapiens
gtaactgtccggccgcggcgctggcttaagccatggctgagggtagccggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggttaatacactgttaaatgtgaaattaagtgagacagaaaatggcaagcatgtctctatattggatctacctggcaacattcttattatccctcaagctacccttggaggaagactaaaaggaagaaacatgcaatatcactctaactctggaaaagaagaagggtttgaactttactctcaatttgtgactctatgtgaaaaagaagtagctgctaatagcaagtgtgctgaagctagggttgtagtggaacatggcacttatgggaacaggcaggtgttaaagctggacaccaacggaccattcacacacttaattgagttttgaaaatgaaaaactagtttctatagctgttttctggtatgaaatgatctaaagtataattagattttcttccccttaatcttgaatatactaatcttcagcatttttagacaggaaaatcttgggtttcatatataactctgcacctgctaattggatgactttgccaagtcacctaaactctggatctcagtcaccttttgtcctacattcctctacccttctacttgaaaatttgaaatatgctgtctattcacttcatagtcattaaggaaatgttcttaattgtttttttgtttttgttttttttttgagatggagtcttgctctgtcgccagactggagtgcagtggcgcaatctcggctcactgcaacctccacctcctggattcaagcgattctcctgcctcagcctcccaagtagctgggactacaggcatgagccaccgtgcccggcctcttagttgttttttaaaaattatgtacattttaagtattttgcaatgaagaaattcatgcaaacaagaaaaacacatttcttataccatcaaatttgtgtagcatgtaataaaaataactatttgtattaaaattaggtaaacttcagcactttgggaggccgaggtgggaggatcacttgagcccaggagtttgcgaccagcctgggcagaatagcaagacccagtctctaacatatacatatacatatagatatatatgtaatatagaagggttattgtgtgttatattactttccagggacattcaaatgttttacattactttaagaatctttacttgatataagaacaaagtataagggtttaaaagttgtttttattaaacatactatataaatgggtt

SEQ ID NO: 1379 - DNA, 3060 bp, Homo sapiens
gaacaaatcaaatcgaagcaaagaaactgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctgctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 1380 - DNA, 2745 bp, Homo sapiens
ttgtacaggtagccaggtgtcggtctccagcctgagaactctggctgttgttccttgtgtcgtcccatattcctgcctggcctgcgatggacatcagcaagggcctcccaggcatgcagggaggcctccacatatggatctctgagaaccggaagatggtgccggtacccgagggggcttacgggaacttttttgaggaacactgctatgtcatcctccacgtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaacttgttcaacatccagcgactgctgcacatcaaagggaggaagcacgtgtctgccactgaggtggagctctcctggaacagctttaataagggtgacatcttcctgctggacctaggcaagatgatgattcagtggaatgggcccaagaccagcatttctgagaaggctcgggggctggctttgacctacagcctccgggacagggaacgtggtggtggtcgtgcacagattggtgtggtggatgatgaggccaaagccccggacctcatgcagatcatggaggctgtgctgggccgcagggtgggcagcctgcgtgccgccacgcccagcaaggatatcaaccagctgcagaaggccaatgttcgcctgtaccatgtctatgagaagggcaaagacctgctgcaggaggaggacttctacatcctggaccagggtggcttcaagatctatgtgtggcagggacgcatgtctagcctccaggagagaaaggctgccttcagccgggctgtgggcttcatccaggccaagggctacccgacctacaccaacgtggaggtggtgaacgacggcgccgagtcggccgcgttcaagcagctcttccggacttggtctgagaagcggcgcaggaaccagaagctcggcgggagggataaatcgattcatgtaaagctggacgtgggcaagctgcacacccagcctaagttagcggcccagctcaggatggtggacgacggctctgggaaggtggaggtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccatggaaaggggcagtcagcatccaccacaaggcttttccaagtgcaaggcactgacagccacaacaccaggaccatggaggtgccagcccgtgcctcatccctcaactccagtgacatcttcttgctggtcacagccagcgtctgctacctctggtttgggaagggctgtaatggtgatcagcgtgagatggcacgggtggtggtcactgtcatttccaggaagaatgaggaaacggtgctggagggtcaggagcctccccacttctgggaggccctgggaggccgggccccctaccccagcaacaagaggctccctgaggaggtccccagcttccagccacgactgtttgagtgctccagccacatgggctgcctggtcctcgcagaagtggggttcttcagccaggaggacctggacaagtatgacatcatgttactggacacctggcaggagatcttcctgtggcttggggaagctgcaagtgagtggaaggaggcggtggcctggggccaggagtacctgaagactcacccagcagggaggagcccggccacacccatcgtgctggtcaagcagggccatgagcctcccaccttcattggatggttcttcacttgggacccctacaagtggactagccacccgtcccacaaggaagtggtggatggcagcccggcagcagcatcaaccatctctgagataacagcagaagtcaacaacttgcggctatccagatggccgggcaatggcagggcaggtgccgtggccctgcaggccctcaagggctcccaggacagctcagagaatgatctggtgcgaagccccaagtcggctggcagcagaaccagcagctccgtcagcagcaccagcgccacgatcaacgggggcctgcgccgggaacaactgatgcaccaggctgttgaggacctgccagagggcgtggaccctgcccgcagggagttctatctctcagactctgacttccaagatatctttgggaaatccaaggaggaattctacagcatggccacgtggaggcagcggcaggagaaaaagcagctgggcttcttctgaacccaagccctctcgactgcccctatcccctggaccccaacatacctacaatgctggggaggccctgcttccactcccctcagaggcttttggtcatcctctgcgtgtcagtaaaagcaggcagcccata

SEQ ID NO: 1381 - DNA, 2157 bp, Homo sapiens
ggccgccatcttggattgcgaactgggtcgctacgcttcacgccaggggcggagtggcggcccttctgttacccgccacacacgtcgccgctggggactgggaaatcagggcatcggagagtgccacattaatggatgccatggctagtccagggaaagataactatagaatgaaaagttataagaataaagccctaaatcctcaagagatgcgtagacgaagagaagaagaaggaatacagcttagaaaacaaaaaagagaagaacagttgttcaaacgcagaaatgtctatttgcccagaaatgatgaatctatgcttgaaagtcctatacaggatccagatattagttccactgtacccattccagaggaagaagttgttactacagatatggttcagatgattttttctaataatgctgatcaacagctaacagcaacacagaaatttagaaagctgctttctaaagaacctaatccaccaatagatcaagttatacagaaaccaggagttgtacagagatttgtgaaatttcttgaaagaaatgaaaattgcactttacaatttgaagctgcatgggcattaacaaatatagcatctggaacttttctgcataccaaggtagtgattgaaactggggctgttccgatttttatcaaacttcttaattctgaacatgaagatgttcaggaacaggctgtttgggcacttggtaatattgctggtgacaatgcagaatgcagagattttgttttgaattgtgaaatacttccacctcttttagagttattaacaaattcaaacagactcacaacaacaagaaatgccgtgtgggccctctcaaatttatgtagaggcaaaaaccctcctccaaactttagtaaggtttcaccttgcttaaatgtcctgtcacgactgttgtttagcagtgacccagatgtgttagcagacgtgtgttgggccctttcttatctctccgatggacccaatgataaaattcaagcagtcattgattctggagtctgtcgaagattggtggaacttttgatgcacaatgattataaagttgtatcacctgcattaagggcagttggtaatattgtgactggtgatgatattcaaacacaggtaattttgaattgttctgcattaccctgtctcttacatttattgagtagcccaaaggagtcaattagaaaagaagcctgctggactgtttctaacatcactgctggaaatagagctcagattcaggctgttatagatgcaaatatttttcctgttttgattgagattcttcagaaagcagagtttcgtaccagaaaagaagcagcttgggctataactaatgcaacatcaggaggtactccagagcaaataaggtatttggtagctttaggctgcattaaaccactttgtgatcttttgactgttatggactccaaaatagtccaagtggctttaaatggacttgaaaatattttacgtcttggagaacaagaatctaagcagaatggaataggcattaatccatactgtgctctcattgaagaagcatatggtctggataaaattgagtttttgcaaagccatgaaaatcaggaaatttaccagaaggcatttgatctgattgaacattactttggtgtagaagaagatgaccccagcattgtacctcaggtggatgaaaaccaacaacagtttatatttcagcagcaggaagcaccaatggatggatttcaactttaacttactggaggaaaaaaaatttatggctaaaaagggtagcttcagaaatgacagactttttcattgaatgatgaggacacagcagccatattatgccaagaggaaaaatatcatgatcatattgaaagatcaagcatgagcttccatggtgaagtcttctgtaccaatgcaccagagaatgcctaccatccaaaaaagcagtcagctgatggaaaagaagattattaaacctttgttctgggatttactgttaaaaaacaaacaaaaaacaacaaaaaagcggtgacaggaaacagttaaggaaatgatttaactgaagggaagcaagatttttttaaagcattgttcttaatccccatgactgtccttcagtcacaattccagaataaaagaatctactttgtgt

SEQ ID NO: 1382 - DNA, 4225 bp, Homo sapiens
agggactgcaggggcgccggcgggcggatcgagaggaaggtcggggccatgggccggcactgcgcctcgggagggtccggccaccgctggaacccgaggccggggctgggggcgctccgggctccgacccacgggccggccggccctgcccgggctgggtgaggggcgcccgcctcaagctagaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcgagtacaaagcagaagaggacccccggctttatcactcggtcaagacgggccgagggccactgtctgatgactgggcacggacggcggcacagacggggccccttatgtgtgcctataagctgtgcaaggttgagttccgctactggggcatgcaagccaagatcgagcagttcatccatgatgtaggtctgcgtcgggtgatgctgcgggcccaccgccaggcctggtgctggcaggatgagtggacagagctgagcatggctgacatccgggcactggaagaggagactgctcgcatgctggcccagcgcatggccaagtgcaacacaggcagtgaggggtccgaggcccagccccccgggaaaccgagcaccgaggcccggtctgcggccagcaacactggcacccccgatgggcctgaggcccccccaggcccagatgcctcccccgatgccagctttgggaagcagtggtcctcatcctcccgttcctcctactcatcccaacatggaggggctgtgtctccccagagcttgtctgagtggcgcatgcagaacattgcccgagactctgagaacagctccgaggaagagttctttgatgcccacgaaggcttctcggacagtgaggaggtcttccccaaggagatgaccaagtggaactccaatgacttcattgatgcctttgcctccccagtggaggcagagggaacgccagagcctggagccgaggcagctaaaggcattgaggatggggcccaagcacccagggactcagagggcctggatggagccggggagctgggggctgaggcatgcgcagtccacgccctcttccttatcctgcacagcggcaacatcctggactcaggccctggagacgccaactccaagcaggcggatgtgcagacgctgagctccgccttcgaggccgtcacccgcatccacttccctgaggccttgggccacgtggcgctgcgactggtgccctgtccacccatctgcgccgccgcctatgcccttgtctccaacctgagcccttacagccacgatggggacagcctgtctcgctcccaagaccacattccactggctgccctgccactgctggccacctcatcctcccgctaccagggcgccgtggccaccgtcattgcccgcaccaaccaggcctactcagccttcctgcgctcacctgagggtgccggcttctgtgggcaggtcgcactgattggagatggtgttggtggcatcctgggctttgatgcactctgccacagtgctaacgcgggcaccgggagtcggggcagcagccgccgtgggagcatgaacaatgagctgctctctccggagtttggcccagtgcgggaccccctggcagatggtgtggaaggcctgggtcggggcagcccagaaccctcggccttgcctccccagcgcatccccagcgacatggccagtcctgagcccgagggctctcagaacagccttcaggcagcccccgcaaccacctcctcctgggagccccggcgggcaagcacggccttctgcccacccgctgccagttccgaggcacctgacggccccagcagcactgcccgccttgacttcaaggtctctggcttcttcctcttcggctccccactgggcctggtgctggctctgcgcaaaactgtgatgcccgccctggaggcagcccagatgcgcccagcctgtgaacagatctacaacctcttccacgcggctgacccctgcgcctcacgcctcgagcccctgctggccccgaagttccaggccatcgccccactgaccgtgccccgctaccagaagttccccctgggagatggctcatccctgctgctggccgacactctgcagacgcactccagcctctttctggaggagctggagatgctggtgccctcaacacccacctctactagcggtgccttctggaagggcagtgagttggccactgaccccccggcccagccagccgcccccagcaccaccagtgaggtggttaagatcctggagcgctggtgggggaccaagcggatcgactactcgctgtactgccccgaggcgctcaccgcctttcccaccgtcacgctgccccacctcttccacgccagctactgggagtccgccgacgtggtggcgttcatcctgcgccaggtgatcgagaaggagcggccacagctggcggaatgcgaggagccgtccatctacagcccggccttccccagggagaagtggcagcgaaaacgcacgcaggtcaagatccggaacgtcacttccaaccaccgggcgagcgacacggtggtgtgcgagggccgcccccaggtgctaagcgggcgcttcatgtacgggcccctggacgtcgtcacgctcactggagagaaggtggatgtctacatcatgacgcagccgctgtcgggcaagtggatccactttggcaccgaagtcaccaatagctcgggccgcctcaccttcccagttcccccagaacgcgcgctgggcattggtgtctaccccgtgcgcatggtggtcaggggcgaccacacctatgccgaatgctgcctgactgtggtggcccgcggcacggaggctgtggtcttcagcatcgacggctccttcaccgccagcgtctccatcatgggcagcgaccccaaggtgcgagctggcgccgtggacgtggtcaggcactggcaggactccggctacctgatcgtgtatgtcacaggccggccggatatgcagaagcaccgcgtggtggcatggctgtcgcagcacaacttcccccacggcgtcgtctccttctgcgacggcctcacccacgacccactacgccagaaggcaatgtttctgcagagcctggtgcaggaggtagaactgaacatcgtggccggttatgggtctcccaaagatgtggctgtatacgcggcgctggggctgtccccgagccagacctacatcgtgggccgtgccgtgcggaagctacaggcgcagtgccagttcctgtcagacggctatgtggcccacctgggccagctggaagcgggctcgcactcgcatgcctcctcgggacccccgagagctgccttgggcaagagcagctatggtgtggctgcccccgtggacttcctgcgcaaacagagccagctgcttcgctcgaggggccccagccaggcggagcgtgagggcccgggaacaccacccaccaccctggcacggggcaaagcacggagcatcagcctgaagctggacagcgaggagtgaggcccacaccagcctggacctgggttatttattgacacacccaaggggcccgaggggctgcgtgtgggaggctggggacccagacttttggccccagcgctggcccccccagccccacaccctatatctccgtgtgctcctcggtgttacttccctttcatatgaggggacccagcgccggggggagggaggagggcgtgggcatgggcgcagaggcttttccagtgtgtataaatccatgaaaataaacgccacctgcacccc

SEQ ID NO: 1383 - DNA, 1116 bp, Homo sapiens
gcggcggcggcagcggcagcggcagcggcgctgagttttgtctcccgggccgtctgggcgcgcgcgggtgtcccagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattgaaa

SEQ ID NO: 1384 - DNA, 585 bp, Homo sapiens
gtgtagagaagggatggatagtgaatgccaaggttagttctagctggataaattagccaagggtttcagctggataagttggctgagggtgctacaggtctagccttaaggctgtctcactgaaacattttggagtctggagtcatctgttctgaatagcgcccacatagtttatatttttttattttttgagacagagtctcactctgttgcccaagctggagtgcagtggcacgatctcagctcactgcaacctctgcctcccgggttcaagtgattctcctgcctcagcctcctgagtagctgggactacagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgc

SEQ ID NO: 1385 - DNA, 5847 bp, Homo sapiens
ggcattatgcaattatattactaaggctgctacctgcccatgcccctctcctcctcctggtttggaactaccctccccatctgctgctatatttatctgccttcttggccataaaaggctggttgtgtggcctgacattcgactgcctgaccacatgcattatttttgaactggcccccagggtcctgtctttagccctgcctcttaacattgtcttggattcaacctaggtggagtcttcattctctcatccagctcctcggcctcatcggaacatttccaccaccattactcctttggaaactggtggcccggttccttcaaggggcacaggatgtctttgcctttttatcagaggtgccaccagcactatgatctcagctaccgcaacaaggacgtgcgcagcaccgtgagtcactaccagcgggagaagaaacgctccgccgtctacacccagggctccacggcctacagcagccgctcctccgccgcgcaccgccgggagtccgaggccttccgtcgggcgtccgcctcctcctcccagcagcaggcctcgcagcacgccctgagctctgaagtcagtcggaaggcagcctcagcctacgattatggctcctcccatggacttacagattccagtctgctgttagatgattattcatccaagttgagccccaaaccaaagagagccaagcacagcctactgtctggagaagagaaagaaaatttgcccagtgactacatggtacccattttctcaggacgtcaaaagcatgtcagtggaattactgatacggaagaagaaagaattaaagaagctgctgcttatatagcccagaggaatcttcttgctagtgaggaaggaatcacaacatctaaacagtccacggcatccaagcagaccacggcatctaagcagtccacggcatccaagcagtccacagcatccaagcagtccacggcatccaggcagtccacggcatccaggcagtctgtggtttccaaacaggccacatccgctcttcaacaggaagaaacttctgaaaagaagtcaaggaaagttgtgattcgagaaaaggcagaacgcctgtccctgaggaaaacattagaagaaaccgagacatatcatgccaagctgaatgaagaccatcttctccatgctcctgagtttatcattaaacctcgctcccacacggtttgggagaaggagaatgtaaaattgcattgctccatagcaggctggccagaacctcgtgtcacgtggtataaaaaccaggtgccaataaatgtccatgcaaaccctggaaagtatattattgagagtcgatatgggatgcacactctggagattaatggatgtgattttgaagatacagctcagtaccgggcctcggcgatgaatgttaaaggagagctttcggcatatgcttcagttgtggtaaaaaggtataagggagagtttgatgagactcgcttccacgctggggcttccaccatgcccctcagctttggtgtgaccccatatggttatgcatcccggtttgagatccactttgatgacaaatttgatgtgtcttttgggagagagggagagacaatgagtctaggctgtcgtgttgtcatcactcctgaaattaaacatttccagccagagatccagtggtacagaaacggagtacctctttctccatcaaaatgggtgcaaacactttggagtggagagcgggcaacgctgacattttcccatctcaacaaagaagatgaaggcctctatacaatccgtgtacggatgggagaatattatgaacaatatagtgcttatgtctttgttcgagatgctgatgcagagattgaaggagccccagctgctcccttggatgtgaagtgcttggaggccaacaaagattatatcatcatctcctggaaacagccagctgtcgatggagggagtcctattctcggatattttattgataagtgtgaggtgggcacagatagctggtcgcagtgcaatgacacacctgtgaagtttgctcgttttcctgtcactggattgatcgaaggtcgttcctatatcttccgagttcgagctgtgaataaaatgggaataggtttcccatctcgagtttccgagcccgtggctgctctggatccggctgagaaagctagacttaaaagtcgcccctcagcaccctggactggacagatcattgttactgaagaggaaccttcagagggtattgtgcctggccccccgacagacctctctgtcactgaggccacccggagctatgtggtgctcagctggaagccccctggccagcgtggtcatgagggcattatgtactttgtggaaaagtgtgaggcaggaacagaaaactggcagcgagtgaacacggagctccctgtgaagtctccccgctttgctctgtttgacttggccgaggggaaatcctactgtttccgtgtccgctgttctaattctgcaggagttggtgagccctcagaggcaacggaggtgactgtggtaggggacaaacttgatatccccaaggctcctggcaaaatcatcccaagcagaaacacagacacctcagtggtagtttcgtgggaggagtccaaagatgccaaagagctggtcgggtactacatagaggcgagcgttgctggctctggcaagtgggagccctgtaacaacaaccccgtgaagggctcacgattcacttgtcatggattagtgactggtcagagttatattttccgggtcagagcagtcaatgcagctggacttagtgaatattcccaggattcagaagctattgaagtcaaagctgctattgggggaggagtgtctccagatgtgtgtcccgcactgagcgatgagcctggtggactaaccgcctccagggggcgcgtgcatgaagcctccccgccaaccttccagaaagatgctttgcttggcagcaaacctaacaaaccttcactacccagtagctctcaaaacctgggccaaacagaagtgagtaaagtaagtgaaacagttcaggaagagcttaccccgccaccacagaaagcggctcctcaggggaaaagtaagtctgaccccctgaaaaagaagacagacagagcaccaccatctccaccctgtgatatcacctgtcttgaaagttttcgtgactcaatggttcttggatggaagcaaccagataagattggaggggcagaaattactggctattatgtgaactatcgcgaggtcattgatggggtaccaggaaaatggagagaagccaatgtcaaggctgtcagtgaggaggcatacaagattagcaacttgaaggaaaacatggtgtatcagttccaagtggcagccatgaacatggctgggctgggcgcgccctccgcagtaagcgaatgcttcaaatgtgaagagtggaccatcgccgtcccaggaccaccgcacagtctcaagtgtagtgaagtcaggaaagactcactggttctccagtggaagccgccagtccactccgggcggactccggtcactggttacttcgtggacttgaaggaggccaaggccaaagaagaccagtggcgagggctcaatgaggcggctattaaaaacgtatacctgaaggttcgaggcctcaaggagggcgtcagctacgtgttccgtgttcgagccataaaccaggcgggagttgggaagccatctgaccttgctggccctgttgtggcagagacccgtccaggaaccaaagaggttgttgtaaatgtggatgatgatggagtcatttcattgaacttcgagtgtgataagatgactccaaagtccgagttctcctggtccaaagattatgtatccactgaggactctccacgattggaagtcgaaagcaagggcaacaagacgaaaatgaccttcaaagaccttgggatggatgacttgggtatttactcttgcgatgtaacagacactgatggaatagcatcaagctacttaatagatgaggaagaattgaaacgtttacttgctctcagccatgaacacaagttcccaactgtcccagttaaatcagagttggcagttgaaattttggagaaaggccaggtccggttttggatgcaggctgagaaactgtctggcaatgccaaagtcaactacatatttaacgagaaggaaatttttgaaggcccgaaatataaaatgcatattgaccgaaacactggcatcatcgaaatgttcatggaaaagctacaggatgaggatgagggaacgtacactttccagcttcaagatggaaaagcaactaaccattctactgttgttctcgttggagatgttttcaaaaagctccagaaagaagctgaattccagcggcaagaatggatcaggaaacaaggtcctcactttgttgagtatttgagctgggaagtgactggtgaatgtaatgtactattgaaatgcaaggtggcaaatattaagaaggagactcatattgtgtggtacaaagatgagagggagatatcagtggatgaaaagcatgactttaaggatggtatatgtaccctgcttataacagagttttccaagaaagatgctgggatttatgaagttatcctgaaagatgaccgaggaaaagataagagcagactgaagcttgtggatgaagcctttaaggaactgatgatggaagtatgcaaaaaaatagctttgtctgctacagacctgaaaatccagagcacagccgagggcatccaactgtactcttttgtaacttactatgtggaggatttgaaagttaactggtcccacaatgggtccgccattaggtactcagacagagttaagaccggggtcactggagagcagatctggctacaaatcaacgagcccaccccgaatgacaaagggaagtatgtcatggagctctttgatggcaaaactggacatcagaagacagtggatctctctggacaagcatacgatgaggcctatgctgaattccagaggttgaaacaagctgccattgccgagaaaaatcgtgcccgggtgttgggaggtctcccagacgtggtcaccatccaggaggggaaggcccttaatctcacttgcaacgtgtggggagacccgcctccggaggtgtcgtggttgaagaacgagaaggccctggcctcagacgaccactgcaacctcaagttcgaggctgggaggaccgcgtacttcaccatcaacggcgtgagcaccgctgactcgggcaaatacgggctggttgtgaagaacaagtatggctcggagaccagcgacttcaccgtcagcgtgttcatcccagaggaggaggcgaggatggccgccttggagtccctgaaaggtggcaagaaggccaagtgaccggaggtgcgaggagagccagccggcctgtgtgacttgggtgtgaatggtttgggttaaggatgagacgtcttcatgctttctcctccctattattttctggcttgaggggaaaataatgtcaggtctttcactcatataaaaaagcaccaactaatgacactttaattgtttttctttatctacaaaattatgtgttaagaaaataccattcatagcatgaagattaggaaacagttttaaggagaagacttgaatgaagttggagggacattgaatgatggtcagagggcagacgaatgtgtcgtggggcgaattgggatttgctgcagctgtgaagccatggccgtgtctcgtgtgttgttacagaggtgatgtgcttttcgacgggcgcctcgtggcttggaacctcctctgtatgaataaacagttttcacgtctgtcctcttccccga

SEQ ID NO: 1386 - DNA, 8320 bp, Homo sapiens
gatatagactgtcaatttcggatccaaagacggcgatggcagagctcacccgggttgcctgtcaaatcaaggctatcgcagaataaatcccgccgcctgccgcgaagccccggcgcaccgcaaacttcagtgagcgaactgggtgatcgctgttgggatatgcagattcctgatgtaaaaggcggggtggcccccccgagagcctctcccgggggccggagcccgcaggtgcagtgaggcgcgcgcgccggtgccggcgcccccagagccgccttgcccgggtagagggagcccggcgcccggcggggtctggcggccgcacaccggcggcggcggcttgtctgcggcggctgcagcggatgatggtggcggccggcccgctgggctgtgcctgtgtgtcgccgcggaaatcagcgccctgcgccgcgcgctgagcccctgcaggtccgccgcagccccagcctcggcgaggacggccccggcgcgcgggggggcggggggcgcgcggggtcggcttatcatggcggatcggacggcgccccgctgccagctccggctggagtgggtgtacgggtaccggggtcaccagtgccgcaacaacctgtactacacggcaggcaaggaggtggtctactttgtggctggggtcggggtggtttacaacacccgcgagcacagccaaaaattcttcctgggacacaacgacgacattatcagccttgccttacacccagacaaaactctcgttgcaactggccaagtcgggaaggagccatatatatgcatatgggattcctataatgtccagactgtgtctcttcttaaagatgtccatacacatggagttgcctgcctggcttttgactcagatggacagcgtttagcctctgtggggttggatgccaaaaacacagtctgcatttgggactggaggaagggaaaacttctggcgtcagccaccggccattctgacaggatttttgatatttcctgggatccatatcagccaaacagagtggttagctgtggagtaaaacacataaagttttggacactgtgtggaaatgccctgactgcaaaaagagggatatttggcaaaacaggggatcttcagaccatcctttgccttgcatgtgccaaagaagacatcacctactctggtgctttaaatggtgacatctatgtctggaaagggctcaatttagtccgcaccattcaaggagcacatagtgctggaatctttagcatgtatgcttgtgaagaaggctttgccactggtgggcgagatgggtgtatacgactgtgggacactgatttcaaaccaataaccaaaattgatctcagggagacagaacaaggatacaaaggcctctctatccggagcgtgtgctggaaagcagaccgccttctagcagggacccaggacagtgagatatttgaagtgattgtgcgagagcgagacaagccgatgttgatcctacagggccactgcgagggtgagctctgggctctggccctgcaccccaagaagcctctggctgtgacaggcagcgatgaccgctctgtcaggctgtggagcctggctgatcatgccttgatcgcccgctgtaacatggaagaggcggttcgcagtgtagctttcagccccgacggatctcagctggccctgggcatgaaggacggctctttcattgttctccgagtcagagatatgacagaagtagttcacatcaaagatcgaaaagaagtcattcatgaaatgaaattttctccagatggttcttaccttgcagtgggatccaatgatggcccagtagatgtctatgctgttgcccagaggtataagaaaattggagaatgcagcaagtcccttagtttcatcacgcatattgactggtccttggatagtaaatacttacaaactaatgacggtgcaggagaacgattgttctacagaatgccatctgggaagcctttaacaagtaaagaagaaattaaagggattccttgggcctcctggacatgcgtgaaaggccctgaagtgagtggaatttggcccaaatacactgaggttactgacatcaactcagtggatgcgaattacaacagctcagtgctggtgtctggagatgattttggactggttaaattgtttaaatttccttgtctcaagagaggagccaaatttagaaagtatgtgggccattctgcacatgtcacaaatgtccgctggtcccatgactttcagtgggtgttgagcacaggaggggctgatcactcagttttccagtggaggtttattccagaaggtgtcagcaacggcatgctggaaactgcaccccaagaaggtggagctgattcctacagtgaagaatctgattcagatttatctgatgtgcccgaactggactctgatattgagcaagaagctcaaatcaattatgatcgccaggtttacaaagaagatctacctcagctaaagcaacaaagtaaagagaaaaaccacgcagtgcccttcctcaaacgagaaaaggctcctgaggacagcttgaaactccagttcatacacggttatagaggctacgactgtagaaacaatctgttctacacacaagctggagaagtagtctaccacattgctgcagttgctgtcgtgtataatcggcagcagcactcccagaggctgtacctggggcacgatgacgacattctcagcctgaccatccatccagtgaaggactatgtggctactgggcaggttggaagagatgctgctattcatgtgtgggacacacaaactctaaaatgtttgtcgctgttgaaaggacaacatcagagaggagtgtgtgcacttgatttttcagccgatggaaaatgtctggtgtcggttggtttagacgattttcacagtattgtattttgggactggaaaaagggagaaaagatagccacaacaagaggacataaagataagatatttgtggtaaagtgtaacccacaccatgttgacaaactggttacagttgggataaaacacatcaaattctggcaacaagcaggtgggggcttcacttctaaaagaggaacttttggaagcgttggaaaattggaaacaatgatgtgtgtttcttacggacgaatggaagatctagtgttctcaggagcagctactggagatatttttatttggaaagacattctactactgaagacagtgaaagctcatgatgggcctgtgtttgctatgtatgcactggataagggctttgtaacaggtggaaaggacggcatcgtggagctctgggatgatatgtttgaaagatgtttgaagacttatgccattaaaagatcagcattgtcgactagctcaaaaggcttgcttttggaagataacccttcaattcgtgccatcactttgggacatggacatatcctggtgggaacaaaaaatggagagattctggaaattgataagagtggcccaatgacactgcttgttcaggggcacatggaaggagaagtgtgggggttggcagctcaccctctcctgcccatctgtgcaacagtgagcgatgataaaacacttcgcatctgggaactatctgcccagcaccgtatgctggcagtacggaaactcaaaaaaggtggaagatgctgtgccttttcccctgatgggaaagccttagcggttggcttgaacgatgggagtttcctggtggtaaatgctgacactgttgaagacatggtctctttccatcacagaaaagaaatgatctctgatattaagttttcaaaagatacgggaaaataccttgccgtggcatcccatgataactttgtggatatttacaacgtacttacaagcaaaagggttggcatctgtaaaggtgcttctagttatattacacacattgactgggactctagaggaaaattattgcaagtgaattcaggtgccagagaacaacttttttttgaagctccaagaggcaaacggcatataataagaccttcagagatcgagaagatagagtgggacacatggacctgtgtcctggggcccacctgtgagggaatctggccagcacatagcgatataactgacgtaaatgctgccagtcttaccaaagactgttcccttttagccaccggagatgattttggtttcgttaagcttttttcatatcctgtcaagggacagcacgcaagattcaagaagtatgtggggcacagtgcacatgtcactaacgtgaggtggctgcacaatgactctgtgctgctcacggtgggcggcgccgacacagccctgatgatctggaccagggagtttgtggggacccaggagagcaagctggtggacagcgaggagtcagacaccgacgtggaagaggatggaggctatgacagcgatgttgctagagaaaaggccattgactacaccaccaagatttatgctgtgagcatcagggaaatggaaggcaccaagccacaccagcagctgaaggaagtttccgtggaagaaagaccacccgttagccgagcagctccccagcctgagaaactgcagaagaacaatatcaccaaaaaaaagaaactggttgaggagctggctctagaccacgtgtttggctacagaggtttcgactgtcgaaataacctgcattaccttaatgatggcgctgacatcatcttccacacagcagcggctggcatcgttcagaacctctccacagggagccagagcttctatctggagcacacagatgacatcctctgtctcacagtgaaccagcaccccaagtacagaaacgtggtggccaccagccagatagggacaacaccttccatccacatatgggacgccatgaccaaacacaccctctccatgctgcggtgcttccactccaagggggtgaattacatcaacttcagtgcaactggaaagctcctggtgtcggtgggagtggaccctgagcacaccatcactgtctggcgatggcaggaaggtgccaaggttgccagccgagggggtcacctggagcgcatatttgtggtggaatttcgccccgactcagacacgcagtttgtatctgtcggggtcaaacatatgaagttctggaccctggcaggcagcgccttgctttacaagaaaggggtcatcgggtccctgggagctgccaaaatgcagacgatgctctccgtggccttcggtgctaacaatctcactttcacgggtgccatcaatggagatgtctacgtctggaaggaccacttcctcatccggctggtggccaaggctcacacaggccccgtgttcacaatgtacacaacccttcgggatggactcatagtgaccggcggaaaagagaggccgaccaaagaaggaggtgctgtaaaattgtgggaccaggagatgaagcgctgccgggcctttcagctggagaccgggcagctggtggagtgtgtgcgctccgtgtgccgtggaaaaggaaaaatcttagtgggaaccaaagacggagaaataattgaagttggtgaaaaaaatgctgcttctaacatcctgattgatggtcacatggaaggggagatctggggcctggccactcacccttccaaggacctcttcatctctgccagcaacgatggcacagcccggatctgggacctggctgacaagaagctgttaaacaaggtgagcttgggccatgcggccaggtgtgcagcctacagccctgatggggagatggtggccattggcatgaagaatggagagtttgtcatcttgttggtgaacagcctgaaagtttgggggaaaaaacgagaccggaaatctgctatccaagatatcagaatcagcccagacaaccgattcttagccgttggttcttctgaacacacagttgacttctatgacctcactcagggcacaaatctgaaccgcattggctactgcaaagatatcccaagctttgtcattcagatggatttttctgcggatggcaaatacattcaggtgtcaacaggtgcctataagcgccaggtgcatgaggtccccctggggaagcaggtaactgaagccgtggtcattgagaagatcacctgggcctcctggacaagcgtcctgggagatgaagtcattggaatctggccacgaaatgcagacaaggctgatgtcaactgcgcatgtgtgacccacgctggcctgaacattgtcacaggagatgactttgggctggtgaagctctttgattttccatgcacagaaaaatttgccaaacataagcgatacttcggtcactcggctcacgtgacgaacatccgtttctcttatgatgacaagtatgtggtcagcactggaggagacgactgcagtgtatttgtgtggcgatgtctgtaaaatgccagaagcctcttatgttattgctgctgctgctaccagccagcaactgcagaggccatgctgaggtgcctccttgccaccagccgttgggaaatgcctaccatgctgccccggatgcacaagctcaaaacgctgcagaagttacacaactgctcccataatctggactctccaaaaccgtgatgccacgaaggaaggtcaagttttaaaatgttaaagactgcttgcctctgttcctgagactaaacagtatacatactaactacattgacaaagaaatcctatctgataatgtagcccgctgacgaattttgaagcctcggttaccctaaccaatatgtagcttttaatttgcatcaaaacttttacaaagatgttttgctattgtttctatatacttcaagaatgttcatttttacaaataagttgaacaagacagcctaagttagatgcaccgaagtactagaaatatcgctagcctctgttctccagtttagctttcaaaaccaaatgagccatgtataaaggagttgagaaacttaatttttaaatgtttcatttgcagagttttatatccattaagtgcctttgaaagtttccagttgtgtgggctgctgtctcacctcccaccaatttctcctttctccatatggtgctaaaacctcaaagctgaggagggctgcaggacccttagcagattcagtgtgtcacccttgtcctgtgttcacgccaaggcttcctaaatgaaagacatcggttacctgcttatgggaaggtgagcagcaaaggaattgaagttcgggacagggtagaattatgggttttcattgtgtttcatgccaaacccacaaaatccaaaatagaattcaagttaaacaaacttctactacaaaatggaaggggaaaaaggctcaggaaggtctatgagaatgagctgacttatctcgttaaatcttaagataaatgagggtaacccaaggctgcaccttggtgtaccaccctgagtggagttgaggtgacttcatttgattgcttcaggcgaactatataggtcaagtccagattataaaaaaattatctgcagaacaaattgtaaacccaaggaatagctggtaaatcaaaattataaagtgagttagagttccttggagttggttgtatgacggaatatgacttggacaatctttaccagaagccatccgtaagcccctcagtcacactttccatgtagctgaccagtgactacaggatgtggctgacagtgctcactgaaaggagagttggtgcgggactggtggttctgagcacatagacgcctattagtccttctggtcagtgaacgaaaattctagacctacagttactggctacttgcatttgtcagtttagagaaaaggtaaaatgaggcattttcaattgtagaatagactaacatttaccacagaagtgcttcagcattctaaatggattagatcactcattaagctatttttatatgccaatttactaatgccttacatcaatccactaataggttgttgggcccgcagtagagtccctatgcagtcccaattctgttttctgtaaccatgtgactggtgatgcagagtgataaccatgtctgcctatcttgtactagactcttcatgctgatcggatcttgcattgaaataaccatgtggaagaacaatgaatcgattaatgatgacatgtacaaccatatttaaagagcaatagtgtccgtgtgtcatgaaaaacttatttgtaaacgtttatatggtatgattttgattttatgtatgttcataaatcctgcactgtatgatatatgtgagttaaaacattggtgcatgaatttattttcaaagtataaaacacatcacttaaacattttatgtgtcaaataaaatttgattatgt

SEQ ID NO: 1387 - DNA, 1133 bp, Homo sapiens
gtctgcgtcagttggtcacgtggttgttcggagcgggcgagcggagttagcagggctttactgcagagcgcgccgggcactccagcgaccgtggggatcagcgtaggtgagctgtggccttttgcgaggtgctgcagccatagctacgtgcgttcgctacgaggattgagcgtctccacccatcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaacattgtgtataacttagaataatgaaatataaggagtatgtgtag

SEQ ID NO: 1388 - DNA, 1886 bp, Homo sapiens
gcgccccctgcgctgccaacccgcgagcccgcatcatggatgtcgagctcccctatttcgcattgctagccctggaattcgagaccccagacgaggaccaggattcatgaaatcagtcgcaggggccggggcaggggcctctggctcccgacactggccgagaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagggaaacttttggaagagtggctgcttatga

SEQ ID NO: 1389 - DNA, 2166 bp, Homo sapiens
ggccctcgcggggggcttgtgggtcctcctccccctcccactgacaactgccccaactgctcttcccgccccggtcacagtgaaaatgtagacggggtcgttgtccactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtatctaagaatgccaaggccagaacaaggaaatgtagtttagtatctggtcacgggagagaaaataaaagctgcagaggttgggggtggggtcagggattctagggatggggcagagtggcagcatcctttgtacctacaggtggatcccacaactcatttgacctttaaccttcacctgtccaagaaagagagagaagccagagatagcctgatcctgcccttccagttcagttctgaaaagtaaggttgggacctgggtacgtggatccctgagtagatcccagcatctgggccatggagaggttggggcaacaggttattgattaacctgactttatagggactgaagtccacctccagagacaagtccaagttcttgatccacccattccccctataatggcagaggacctttatgtctcttttctctcccttatacccttgggtcacagctccagttgtccccagagcaccctgggcctgggctgagccagaccagacccttgggaggtggccctatccctaggcagtggtgctaggaggacagaaggctatatgggcgtggcagaggctggttaacaagggcttagtacacgcttgctgttctgtgcccagtatgtgggcggatgacgcaagactacaagatccttgccctcaagctgctaggaacttacggttttattaggagagcagtacaagggtatctatcccagtaccaaatggtgcttcagctctaacatggaggtcagagaaagggacttggaccaataaaatgacatggaggcctaacaggttgcctgaatgagagtcacagtcacctggaagaaagtatccagacccaacctgttagctaccctcaccagcaccaaatcttcccttctcagacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttatt

SEQ ID NO: 1390 - DNA, 834 bp, Homo sapiens
ggacagcttggagatagggcccggaattgcgggcgtcactctgctcctgcgacctagccaggcgtgagggagtgacagcagcgcattcgcgggacgagagcgatgagtgagaacgccgcaccaggcctttgcggggagcttctcctgcaaagaggaaccacgaaggtggccacaggtctggttctgaacagagaccagaggctcgcctgggcagagaacagcattgacttcatcagcagggagctgtgtgcgcattccatcaggaagctgcaggcccatgtcctgttgatcaaagcagtccacggatattttgattcaagacagaattactctgagaaggagtccctgtcgttcatgatagacacgatgaaatccaccctcaaagagcagttccagtttgtggaagtcccaggcaatcactgtgtccacatgagcgaaccccagcacgtggccagtatcatcagctccttcttacagtgcacacacatgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagggggagacagagtctgggttccagggctgctttctcctggctaataataaatatccagccagctggaggaaggaagggcaggctgggcccacctagcctttccctgctgcccaactggatggaaaataaaaggttcttgtattctca

SEQ ID NO: 1391 - DNA, 3667 bp, Homo sapiens
gtgctgctagaaaccacgaacattagtcatctcgcagcatgtgtgcacatggggtgacccgggggcctcctcgaatgcagcgtctacgcctggtgaatggacgcactcttaccaattctgctctgggagatgcagcggtaacctaccgagcgcagaggccggcgcgcacccgtggagcccgcgctcgcgatccctcctcgtgccagggccccagggcagtcaaggcctgccgaccgttaggcgggtcaaggggtacacagggtgcgaattcgttaggcaaaagctgggtacaggcgcgagccacaggcacggaaacctcgcgccgaccggggccctaggcccgacgacggcaggtaaggggaagtggaggcacacagggctgggacgtgccccaggcaccatacgggtggcttcgggcgcgggacgtccgcagccccgcagctcccaggacgttcgacaatctgcagctgaccagcttcggccggtttggggataaagggaagacaggcggcgcggggagtgggaacgcctgaaggccgcgcccctcctttcaggtcggccaggagcgcgccggtaagagcctgggggcaaggggtagaaagacgcccacctcatcacaacccagagctcgggactcctatacagtcccatagggaacaggcggccgccattcccctcccccacgctggcgggtaaggctagagaacggtttcaaggaagacgcatgcgcatgaaataattataaaccgctaggactccgaagttcaatattcgcgggaaggcgcaggcgcaacaaaaagcccggcgggtttatgggtgggggtgctgagcccaaaacccaagcgtgtaataatccgccggcgggaggtgggctggctcttgaaattacgcatgcgccagagctctttgtgacgcaacggggcggtgcgggcagctggctgcgcgtgcgcagaactcgcacaagggaccttatttaggttgcgcaggcgcccgctggccatttcgtcttagccacgcagaagtcgcgtgtctaggtgagtcgcggtgggtcctcgcttgcagttcagcgaccacggtgggtaccgtttttgcgaggattgtttgtccccatatctctgggagggccacggggaccttggcgagctgcaggctgccgtcgagagccgcgagtggttcgctgaatctcggcaccgccgctgaggcctgcaggccgcgccgactctattgtgtgagaagtcggaggaggcggagcggaagcggccgccgccatttcctttcctctacgctggctctcggcccgggcccccacggttcggggcgccgacagctgttgctcaggacagctttgggggtccggtcgccggacgaggaggtgttggagtcgccggggtgggtgcatccgcccggtttttgctccgtgggggggcggtgcgggcccgggcgcgcctcggaggcgaaggacagcttaattggcgctctcagttctggtcctccccgctttgcagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgc

SEQ ID NO: 1392 - DNA, 5015 bp, Homo sapiens
gaggtcagaccggttgctttcccgggagttcggcgtttgctggggctgcagcagctgaagtgtagtgttttcttgggactggcggtctgcacttctctcccgggttccatctccccccgcccggtggtgaggccctcgaggagggctcggacgggtgtagcgatccgcgctagaggaagacgaggcccgggaacgcatgtcccccagggcaggttagggggctggaggggtcaaatcccggggtacttgtggagactctttagcgtggcttcttctctctgctgagaccccgagagctttcccagttctcctcccaggaccaccggggttcctgaagatcgggacttttctgcgcccctccaccaacagcccatctcctgtctatgaagaaagacccttcgtagaaacaacttccccgctgctgacgcgttttcccgtcccgtccccgaagtagtctactatgacctcgttgtgagcctctgaacgattttgacactttcccgaggcctagggtattatatcctaaccttactaaagaccacagaggtgcttgccattatgggaaatcagcttgctggcattgctccctcccagatcctttctgtagagagttatttttcagatattcatgactttgaatatgataaaagcctggggagtactcggttttttaaagttgctcgagccaagcaccgagaaggcctggtcgttgtgaaggtttttgcaattcaggatcccacattgcctttaaccagctataaacaagagctggaggaactgaaaatcaggcttaattctgcacagaattgtctacctttccagaaagcatcagaaaaagcatctgagaaagcagctatgctctttaggcagtatgtgcgagacaatctctatgatcgcatcagtacccgtccattcttgaataacattgagaagcgctggattgctttccagatcctgacagctgtggaccaagcacacaaatctggagttcgtcatggggacatcaagactgagaatgtgatggtcaccagttggaattgggttcttctaactgattttgccagttttaagcccacttatcttccagaagacaacccggcagatttcaattatttctttgacacatcacggaggagaacttgctatattgctcctgaacgttttgttgatggtgggatgtttgccactgagttagaatatatgagagatccttcaactccgcttgtagacttaaatagcaatcagagaacaagaggagagttgaagagagcaatggacatcttttcagcaggttgtgtgatagctgagctttttacagaaggtgtaccattatttgatctctctcaacttttggcttatagaaatggacattttttccctgaacaagtgctaaataaaattgaagatcacagtatcagagaattggtaactcagatgattcaccgtgagccagataaacgtttagaggcagaagattacttaaaacagcagcgtggcaatgcctttcctgaaatattttacacttttcttcagccctacatggcccagtttgccaaggaaacgtttctttctgcagatgagcgtattctggttatacggaaggatttgggcaacattattcacaatctctgtggacatgatctgccagaaaaagccgaaggagagcctaaggaaaatgggctggttatcttggtatctgttataacatcctgcctacagacccttaaatactgtgattccaaactagctgctttggaactgattcttcatttggctccaagattaagtgttgaaatccttttggatcgtattactccatatcttttgcatttcagcaatgactctgttcctagggtgagggctgaagccttgaggacgttgaccaaagttcttgctctcgtcaaagaggttcctcgtaatgatatcaatatttatccggaatacattctgccaggcatagcccacttagcccaagatgatgctactatcgttagactagcctatgctgaaaacatagctctgctggcagaaacagctctgagattcctggaattagtacagttaaaaaatcttaatatggaaaatgaccccaataatgaagaaatagatgaggttacacatccaaatggaaattatgacacagagctccaagccttacatgaaatggtccagcagaaagttgttactttgctaagtgaccctgaaaatattgtaaaacaaaccttgatggaaaatggaataacacggctgtgtgtattctttggacgtcagaaagccaacgatgttttgttgtcccacatgattactttcctaaatgataagaatgattggcatctacgtggagcattttttgatagtatagttggtgttgctgcctatgttggctggcaaagctcctcaattctcaagcctctgctgcaacaaggtcttagtgatgctgaggaatttgtcattgtgaaagctctttatgcccttacttgtatgtgccagttaggactgctacaaaaaccccatgtttacgaatttgccagtgatattgcccccttcctgtgtcatcccaatttatggatacgttatggtgccgtgggatttatcacagtggtagctcgtcaaataagtacagctgatgtctactgtaaactgatgccttatcttgacccatatattacccaaccaataatacagattgaaagaaaacttgttctgctcagtgttttaaaggaaccagtaagtcgttctatatttgattatgctttgaggtctaaagatattactagcttgttcagacatcttcacatgcgtcagaagaaacgaaatggttctcttcccgactgccctccgccagaggatcctgccatagcacagcttctgaagaagttgctctcacagggaatgacagaggaagaggaagacaaacttctggcactgaaagacttcatgatgaaatctaataaagcaaaggccaatatagtggaccagagccatcttcatgatagtagtcagaaaggtgtaattgacttggcagctttaggcataactgggagacaagttgatcttgttaaaaccaaacaagaaccagatgacaaacgggccagaaaacatgtaaaacaagactcaaatgtaaatgaagaatggaaaagcatgtttgggtcactggacccaccaaacatgccacaggccctacctaaagggagtgatcaggaggtgattcagactgggaaacctcctcgttccgagtcctctgctggcatttgtgtccctttgtcaacttcttcacaggttccagaagtgacaactgtccaaaataaaaaaccagtaataccggttttaagtagtacaatcttaccatccacctatcagattcgaattacaacttgtaaaactgaacttcagcaactcatccagcaaaagcgggagcagtgcaatgctgagagaatagctaagcagatgatggaaaatgctgaatgggagagtaaaccaccaccacctggatggcgtcctaaagggctgttagttgcccatcttcatgagcataaatctgctgtgaatcgaattagagtctctgatgaacactcactttttgcaacatgttcaaatgatggcacagtgaaaatctggaacagtcaaaagatggaggggaagaccaccactaccagatctattcttacatacagccgaattggaggacgagtcaagacgctcacattctgccaaggctcccactatttagccatagcatctgataatggtgctgtccagcttcttggaattgaggcttctaagctgcccaagtctcctaaaatccatcctctacaaagcagaattctagatcagaaggaggacggttgtgttgtggatatgcatcacttcaactctggagcacagtctgttcttgcctatgccactgtgaatggctctctggttggctgggaccttaggtcttcaagcaatgcgtggactttaaagcatgatttaaagtcgggcctcatcacttcctttgctgtggacatccaccaatgctggctctgcattggtacaagcagtggtaccatggcttgttgggacatgaggttccagttgccaatttcaagtcactgtcatccttccagggctcgaatcagacgcctctcaatgcaccctctgtatcagtcctgggtgattgcagctgttcagggcaacaacgaagtgtccatgtgggacatggagactggtgacagaagatttactctctgggccagcagtgcaccaccactttctgaattacagccttctcctcatagcgtccatggtatctactgtagtcctgcagatggaaatcctatcctactaacagctggctcagatatgaaaataaggttttgggacttggcttacccagaaaggtcctatgttgttgcaggaagtactagttccccatctgtgtcctactacaggaaaataattgaaggcactgaagttgtccaggaaattcagaataagcagaaagtaggaccaagtgatgacacccctcgaaggggcccagagtccctgcccgtgggacatcatgacatcatcactgatgtcgccacattccagaccacacagggcttcatcgtaactgcttctagagatgggattgtgaaggtgtggaaataaaacctactgatttgtataaattttaatagttataaatataatactataactcgagaaaaggcatttctagagaacagattcatttgcttaattttcaaaattatgtctccatattactgtttcatgactgactgactaaatgacacccaaaatggttaagatgtacttgactagtttacttatgcatctctttgcaagaatcagccagccaacaatgtctgggatttttattgtatatgttatagaggtgagaaatgtaaaatatgaaaatgaatatgtttattttgtattgaaaaagatggttgaaaagatggttgtaagctattatagtataaacacatttttgctattaaaaatgctattcaaagcagttaaactgt

SEQ ID NO: 1393 - DNA, 1289 bp, Homo sapiens
gcctgggaggagactctctgagggtgtagagctagagggagcattcactggccatgccagtagttaccactgatgctgagtcagaaacaggtatcccaaaatccctttccaatgagcctccctcagaaaccatggaggaaatagagcacacatgcccacagcctcgactgaccctgactgcacctgccccatttgctgatgaaaccaactgccagtgtcaagcaccccatgaaaaactgaccattgctcaggcccgcttaggaacaccagctgacaggcctgtcagagtatacgccgatggaatatttgacctcttccactcaggtcatgcaagagcccttatgcaagcaaaaacactgtttcccaacagctacttgttggtaggagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaagattgactttgtggctcatgatgacattccgtattcctctgctggctctgatgatgtttacaagcacataaaggaagcagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatggaagcagatgttccaggagaggagcagccggatgctgcaggccttatccccgaagcagagccctctgaagagttgggcgaggtgcagagacttctagctggacaacctacacaaaccttagcgtctagagtcactctaaccttgctaaggaaggatgcagagttccctagagagacttgcactgatggggtgacttctgctttggtccttccaccacccccaccaagtaaaccacctgtggcagcggctgttccctcaacctgctacttctgcgtccataagggtcctgcacgttgcctcccaccaccccagctctgccagaataaaattgtttccaata

SEQ ID NO: 1394 - DNA, 3466 bp, Homo sapiens
gccagcgtcccacaccagccgcaggtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgcacagtgcttggtactgagatagcagcatcaaggagcattgtgtacatgcagaagtgcacagtacctggagtgaaactgcttgtgttcgatttctgataccattcataactggctgtgtgatctcaaaacctctaaaatgcagacctccagctctagatctgtgcacctgagtgaatggcagaagaattacttcgcaattacatctggcatatgtaccggaccgaaggcagatgcataccgtgcacagatattacgcattcagtatgcatgggcaaactctgagatttcccaggtctgtgctaccaaactgttcaaaaaatatgcagagaaatattctgcaattattgattctgacaatgttgaatctgggttgaataattatgcagaaaacattttaactttggcaggatctcaacaaacagatagtgacaagtggcagtctggattgtcaataaataatgttttcaaaatgagtagtgtacagaagatgatgcaagctggcaaaaaattcaaagactctctgttggaacctgctcttgcatcagtggtaatccataaggaggccactgtctttgatcttcctaaatttagtgtttgtggtagttctcaagagagtgactcattacctaactcagctcatgatcgagaccggacccaagacttcccggagagcaatcgtttgaaactccttcagaatgcccagccacctatggtgactaacactgctaggacttgtcctacattctcagcacctgtaggtgagtcagctactgcaaaattccatgtcacaccattgtttggaaatgtcaaaaaggaaaatcacagctctgcaaaagaaaacataggacttaatgtgttcttatctaaccagtcttgttttcctgctgcctgtgaaaatccacagaggaagtctttttatggttctggcaccattgatgcactttccaatccaatactgaataaggcttgtagtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggatacttggaaagtttgttcctcctatacccaagcaagatgggggagagcagaatggaggaatgcaatgtaagccttatggggcaggacctacagaaccagcacatccagttgatgagcgtctgaagaacttggagccaaagatgattgaacttattatgaatgagattatggatcatggacctccagtaaattgggaagatattgcaggagtagaatttgctaaagccaccataaaggaaatagttgtgtggcccatgttgaggccagacatctttactggtttaaggggaccccctaaaggaattttgctctttggtcctcctgggactggtaaaactctaattggcaagtgcattgctagtcagtctggggcaacattctttagcatctctgcttcatccttaacttctaaatgggtaggtgagggggagaaaatggtccgtgcattgtttgctgttgcaaggtgtcagcaaccagctgtgatatttattgacgaaattgattccttgttatctcaacggggagatggtgagcatgaatcttctagaaggataaaaacagaatttttagttcaattagatggagcaacaacatcttctgaagatcgtatcctagtggtgggagcaacaaatcggccacaagaaattgatgaggctgcccggagaagattggtgaaaaggctttatattcccctcccagaagcttcagccaggaaacagatagtaattaatctaatgtccaaagagcagtgttgcctcagtgaagaagaaattgaacagattgtacagcagtctgatgcgttttcaggagcagacatgacacagctttgcagggaggcttctcttggtcctattcgcagtttacaaactgctgacattgctaccataacaccggatcaagttcgacccatagcttacattgattttgaaaatgcttttagaactgtgcgacctagtgtttctccaaaagatttagagctttatgaaaactggaacaaaacttttggttgtggaaagtaagtgggatacttggaatcaaggcatctctgtagtacagtcttctttattttttagcatagaaagttggggatgtgttaattgtatttttaagaatatattctaagttctgtacttcaaataatagcacagattttacatctgattgacatagtgtatgttaatgtaagttttgctttccagtgattacctgatacgtaagcctatttgaacaaagtgagaatgaacttttgtttctaagaagtctttatcttgaagctatataacatgaaaagtgagctcaaattttttttagttgaagattacatataaagttgtgtctgattaatattcatcttttattgaagaaagtgccttctgatggccacataattcttaatgtcagctagtataatggtttacatttggacaaagtattgcttagtgttatttaagtagatttaagatctcaaagctaaagtgccaatttttactttcttcagccaatttgttacctcttttatggtttttaatttttatcaggactaacattttcagaaatagcaaggtgtgatctagtattagattcacagaactgaaaggttaattaagaatgttggttattttcacgggagcgtgtgatatttaacattaatattttatttgacactacagcctgtaatactgctctctttcaaaaacaagttttcagatttttataacagacccattttgttttatgaaacatgttcattacagaaacatgagaaaatagagataagtaaaaagaataaaagtcactattatcctaccactttgcgggacacactattaatatttaagcatagattcttccagatgttttgttttatacagcagtaggattgtgtaatgtattctctcttgtagcctattcttcaaagcgtatcttcactttccatgttaacataaatgtccttttatgattgtctaggattccatggatggatggaatataattgagtcatctggtagagcgcatataggacaggacgctaggttgtttatcttttgtttattgtaaaggaactatgtgggatgcatttggtgatctttttaaaaaatgtataaatttcttgagtaattcctggattaaagaatatgcactttttaaa

SEQ ID NO: 1395 - DNA, 2626 bp, Homo sapiens
gctgaaggctcggttcatgccgtgcccccgggcagttctggtgaggctaagcaagaggcctctgcatcttgacacctaggagagcagggacggagtctcccagggtggaggaccatgctgcgccgcaagccctccaatgccagtgagaaggagcccactcagaagaaaaagctctcccttcagcgctccagcagcttcaaggattttgccaaatccaaacccagctcccccgtggtgagcgagaaggagtttaatctggatgataacattccagaagatgactcaggtgtccccaccccagaagatgctgggaagagtggcaaaaagctggggaagaagtggagggcagtgatttcccgaaccatgaacaggaagatgggcaagatgatggtgaaggccctgtcagaagagatggcagacactctggaggagggctctgcctccccgacatctccagactacagcctggacagccctggccctgagaagatggcgctggccttttctgagcaagaggagcatgaacttccggtgctcagccgccaggcatcaacaggcagtgagctctgcagccccagcccaggttctggcagcttcggggaggaaccacctgccccccagtacacagggcctttctgtggccgggcacgagtccacaccgacttcactcccagcccctatgaccacgactcgctgaaactgcagaaaggagatgtgatccagatcattgaaaagccacctgtgggcacgtggctgggcctactcaatggcaaggtgggctctttcaaattcatctatgtggatgtgctgcccgaggaggccgtggggcatgcccgccccagccgccgacagagcaagggcaagaggcccaagcctaagaccctgcatgagctgctggagcgcatcggcctggaggagcacacatccaccctcctgctcaatggctaccagacactggaagacttcaaagagctgcgagaaacacacctcaatgagctgaacatcatggatccacagcaccgggccaagctgctcacggccgccgagctgctgctggactatgacactggcagtgaggaggctgaagagggcgccgagagcagccaggagccagtggcacacacagtgtcggaacccaaggtggacatcccgcgcgactcaggctgctttgagggctcggagagcgggcgcgatgacgcagagctggcaggcactgaggagcagctgcaaggcctctccctggccggggcaccttgaggtggcggtggcaataggccaaggctgggacccagctgcaaaggctgtaggagtgggcccagcctcccgtggtggcccaggtcctgaggactggcactgagcctggccctgcttccccagggacacttagggccacagaggccaggccagggccctacaggttccaggctcagctggagtggttggggagtcgcccaagggcacatcccacctgcctgagccccgccctccaccagcgactgacagcgcagcccctcctggcaccaactgctcccctgccatggccacggccacagcaagtggggcactgggaaaccctgcccatgtccctcaccaacaaggcctccaaatcctcctcacccccacaccacctacccctgtcgcactgctcctgaaaagggggccaagtcaatgtttcaggtcagtctaaaaaccctagggaagctggccatttaaaagaacccaaactgaccatgggtaaatccagttcccctaaataaggcctgaagaaatccacaggtaccattcccactttccttctccctagctttcttagaggtttggccactaaatcttatgagacttgaaccaagtggcttcctctttctaggcttaggacgggttggggttagaaagggtgatcactgaaggccttgcctgctctgacattctgtgacattaaatgtctattctcctgttacctgtggcctgggacaccagtggggtttatcgaggggaccagaggggcctcaggctttcagatgaaatggctcctcctactcacccactttattcctctccatgtaattcaggacaagctgcaacttcccccagcttaacacaatgcccatacctcatacgatatgcgccctcccgttccatccctggccccctcaaacgagacttctcacaaggctgattacagatggtcaaacctggcttccaaggacagaattgcctctcggaagccagctgtggatctgagtccagagttggccacttgtgtgggtcctcacaagcaaagagagcactaaacttgacattgggggtccaccactccaactttgctttctgaaggttttggtgtacattgagccccagaaggaaaggagagtatctgtgagtgggggcctcccttgaccccagtacgaagtctatgccctgaatccccagagtagcccttcctggtgcccaactggcctggggacaaacagcgtccactacatctaggactgccggctaagtggacacacttcttgacctcctaccaggaactttggtaaaagctagctttggggaaggggttgggtgtaaatatgagagggtggagggagaccagctggtagcaataaacatgggtagaactaaa

SEQ ID NO: 1396 - DNA, 2680 bp, Homo sapiens
cctgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagta

SEQ ID NO: 1397 - DNA, 2264 bp, Homo sapiens
gatggaatagcattgacccagtttacaaagccatctgaagtgcctgagttgtatttgaagggtttcaccatgttggccaggctggtctcaaactcctgacctcaagtgatctgcccacctcagcctcccaaagtgttgggattacaggcgtgagccaccacacccagccaagagatacttcttgaatagttttattctgtatctacttgaaatataagtgaactttttgtttatttggaatgcttttcttggcaatcccacagagtattgatgaggaaactgaagtttggagcgatcacatcattttcccaagaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacaatgaattcacaacctcaaacccgttctccgtttgcagcggggcctcgacctccccatcatcagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaactataagaattcgggatccaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaaggtatatgtcacgaaa

SEQ ID NO: 1398 - DNA, 2437 bp, Homo sapiens
gccttctggcagtttctgggagctgcgaacgcgccgccccggggctcggcggccggaaacgctggcttcggagccttaggcgccgcggcctttccttgttttccgcccagtccacgccgccatggccaagtggggccaggggaacccccactggatcgtggaggagcgggaggacgggaccaacgtgaacaactggcgctggcgcggctggcggcggcctccttccgggatctggggagggccgggccgcgggagccggggctgccctggggtctgtgcggggccgcggggccagggggtcagggggccgccccccctcagctgctggacgcagggctcggccttcgcctctcggctcgggagagtccttgagtacggagaccggctaggagggttgcagctgcctctttttgaaagttgggttgggccccaagagtgacttccgacagacctttccactcccaccgtctgtggcctgagggccttcccttctcctcccgcccacccctctggatgtttcggggagttagaagggagctggattgagagactgtgttaggggcgggggtatggaacgtagtggaaagggcagaaatttggatctcagttcgcgcccaccccgcaggcgcctcccgcgagccgggccctctgtgagtgagacaagctccccttcctttacgcgcctcacctggcgcgtggggagaggtcggcagccctccgccgcagaacctccggaagggatgtcctctgccctgcgcctctggccggggctgtggtccctccaggccgtcgaggggatgctgaggccggtccccagaggagcatgacttggctggtccggaggagctctgagggcatgggcaatcttggctcgctgcaacctcagcttccagagttcaagcgagtctcctgcttcagcctcatgagtagctgggactacagatgcgtgccactacgtccgtctgatgacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgagaatttacaacgggaatgattttaccaacgaaagctatggcaacccaggaattgactgtcaaaagaaaactgagtgggaataccctgcaggttcaggcctcatctccagtggcactgggtgtaaggattcccactgtggctcttcacatgatggaactgtttgacacaactgtagagcagctgtatagcatcttcactgtaaaggagttaacaaataagaagatcatcatgaaatggagatgtgggaactggccagaagaacactatgccatggttgcactgaattttgtgcctactctagggcaaacagaattacaattgaaggagttcctatctatctgtaaagaagagaacatgaaattctgttggcagaagcagcattttgaagaaataaaaggttcactgcagctgacccccctaaatggttgaattaaaatttattataaggcattactttttgtaagcggaaaaagtgtcacatttacctcttccctatcttttgtttaaaaggactgtctttattttatattggatgaaatctatgaacatatatacaatgtaaagcattgtttgactctttattataactagacactgcattgatttaaaagtagcaaacaacctgaaattaagtattaacctgaccttccatcgatattcctctggaaataggtaagtcctgagtgcagatagttgatgtttcccaagctgaagcttgtcctatagcaagcttgcttgcagctgtacttttagttcaagatgacaaaaaataaatggcatgttgacactattcctttattttactttagggtttttaaggtgtgtagatcttaggtcgtaaaacagtggtatattgcattcaaaagcatgttgaggtgagggcaaattggctgtgttttgctccacatctccctgcacatctccctgctgtggttttgcacttcggtgtggagaggattgagaagtctgtggggacacattagttctgtggactgctggtaacacttccagtgaaacagcatataatggataaatgtttcccccctctttcacggttttctcactactttcacctgagaagactgaagcaacgtatgtaaacaaatgaaaagtcatcacaatcagtttaattaagtgcacagaatagcaatcaatcaatcagtcatgtcaataaaaataaaacaattattttta

SEQ ID NO: 1399 - DNA, 2617 bp, Homo sapiens
cggttcccgtagccttagctctcggccccgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaactttt

SEQ ID NO: 1400 - DNA, 1555 bp, Homo sapiens
acaagatggcggcgctgcgggacggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagctgatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggccccagtcccggtcccggtcccggccccagtccctgtcctggacccagtcccagcccccaataaagcacccgccccctc

SEQ ID NO: 1401 - DNA, 1662 bp, Homo sapiens
gctgcgggctccgcgcgcgcgggccatgtccgctttctgcctgggcttggtcggccgcgcttcagcacccgccgagccggacagcgcctgctgcatggagctgcccgccgcggccggggacgcagtccggagtcccgccgccgccgccgccctcatcttccccgggggctccggggagctagaactggcgttagaggaggagctggcgctgctggcggccggggagcggccgtccgaccccggggaacaccctcaggccgagctgctgtcggtgatccgacagaaggagaaggatctggtgttggcggcccggctgggtaaggcgctgctcgagaggaaccaggacatgagccggcagtacgagcagatgcataaggagctgacagacaagctcgagcacttagagcaagagaaacatgaattgagaagacgatttgagaaccgagaaggggagtgggaaggccgagtgtcagagctggagagtgatgtgaagcagctacaggatgagttggagaggcagcagattcatctgcgggaagcagatcgagaaaaatcacgggctgtccaggaactgtcggaacagaaccaaaggctattggatcagctcagcagggcatcagaagttgagagacaactctccatgcaggtccacgccctcagagaagactttcgggagaaaaactcatcaaccaaccagcacattatccggctggagagccttcaggccgagatcaagatgctgtcagatcggaaacgggagctggagcatcgtctcagcgctactttagaggaaaatgacctgctccaagggaccgtggaggagctacaggaccgggtgctaatcctggagaggcagggccatgacaaggacctacagctgcaccaaagccagctggagcttcaggaggtgcgtctctcctgccgacagctgcaggtgaaggtggaagaactcactgaggagaggagtctgcagagctctgccgccaccagcacatccctcctgtcagagatcgagcagagcatggaggctgaggagctggagcaggagcgagagcagctgagactgcagctctgggaagcctactgccaggttcgctatctgtgctcacaccttcgaggcaatgacagtgctgactcagccgtctccacggactcctccatggacgagtcttcagaaacctcgtccgccaaggatgtgccagccggcagcttgcgcactgccctcaatgagctcaagagactgatacagagcattgtggatggcatggagcccacgggctcccggagacttgatgatgactccttagaagaacagataaggcagaccagtgaggactcgagagccctaagggagctcatggagggagagagggggaggctgccggaagcctccagatgctgcctgcctgcctgctcacaaccgattcagtctccctccctccctcacgtggggaaagcacagcagggatgcgcggcaagaatgtacctgtagatgtgtacataccacagtgctgtaattttgtatgtagcaatcatgtaaatacatgtatggattttataatatacatatataaaaatctataaaggcatatttttagaaaaacagcacaccactgcttcttttgaaaatagtctgaataagaataaaatgaatttctacag

SEQ ID NO: 1402 - DNA, 1428 bp, Homo sapiens
atgacacgtggcaccgggggaactgcccagcgtggaaggtctgggccagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtga

SEQ ID NO: 1403 - DNA, 2437 bp, Homo sapiens
ctgagcgggtgcgcgggcaacttccggtgtgggtgacgagtggtggccgaagcagggggacagcaagggacgctcaggcggggaccatggcggacggcggctcggagcgggctgacgggcgcatcgtcaagatggaggtggactacagcgccacggtggatcagcgcctacccgagtgtgcgaagctagccaaggcttccgatatggtatcgacatcccgtatcttagttgcagtagtgaagatgtgctatgaggctaaagaatgggatttacttaatgaaaatattatgcttttgtccaaaaggcggagtcagttaaaacaagctgttgccaaaatggttcaacagtgctgtacttatgttgaggaaatcacagaccttcctatcaaacttcgattaattgatactctacgaatggttaccgaaggcaagatttatgttgaaattgagcgtgcgcgactgactaaaacattagcaactataaaagaacaaaatggtgatgtgaaagaggcagcctccattttacaggagttacaggtggaaacctacgggtcaatggaaaagaaagagcgagtggaatttattttggagcaaatgaggctctgcctagctgtgaaggattacattcgaacacaaatcatcagcaagaaaattaacaccaaatttttccaggaagaaaatacagagaaattaaagttgaagtactataatttaatgattcagctggatcaacatgagggatcctatttgtctatttgtaagcactacagagcaatatatgatactccctgtatacaggcagaaagtgaaaaatggcagcaggctctgaagagtgttgtactctatgttatcctggctccttttgacaatgaacagtcagatttggttcaccgaataagtggtgacaagaagttagaagaaattcccaaatacaaggatcttttaaagctttttaccacaatggagttgatgcgttggtccacacttgttgaggactatggaatggaattaagaaaaggttcccttgagagtcctgcaacggatgtttttggttctacagaggaaggtgaaaaaaggtggaaagacttgaagaacagagttgttgaacataatattagaataatggccaagtattatactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacatatttcctttctacagttacctctgattctcaacattttgtggggtagtgatttggcaagtgttttttaaataaaacaaatctcattgtaaagctatcagtcatttagtagaatagaaaagcaacatagagcatacaagaacatttgggatagagttgtgatttgtgaagaatttgtactttgatattgtggcggaaagtctagactgagtgtgtatgctggtaaactgtagacttttttttttttttttttgagtccggctggttccaatcacagtagcttgattgctttcagccctcatcctctcacttgatcagttgttcaacagaatcagctgacataattgacacagtttattgggtgttaagtccgctctatagggatagtgactactttttttttttttttttttttgctcttcttcctctcccctttctttatatgggtttaaatttaacataaagttgtttttataaggcttatttgtggctttaacttgtaagtctgattacatcattattgttccaaattcattatctctgtaggaacttttagttccattatatgaacactggataacctaattttttttaatgctttaaaaaaatggcaaaaagacgtcaggccaccctcatagtaagtggtgtagtattaaaatattttcacggaattaaaagtagcttgctgtcaaagaaacacctg

SEQ ID NO: 1404 - DNA, 1999 bp, Homo sapiens
agcgcgagccccgccgccgccgagcatggacgaccccgactgcgactccacctgggaggaggacgaggaggatgcggaggacgcggaggacgaggactgcgaggacggcgaggccgccggcgcgagggacgcggacgcaggggacgaggacgaggagtcggaggagccgcgggcggcgcggcccagctcgttccagtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccagggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaa

SEQ ID NO: 1405 - DNA, 1705 bp, Homo sapiens
agaggcagagacacacgcggagaggaggagaggctgagggagggaggtggagaaggacgggagaggcagagagaggagacacgcagagacactcaggaggggagagacaccgagacgcagagacactcaggaggggagagacaccgagacgcagagacacccaggccggggagcgcgccctcccctcggcgggcacggtatttttatccgtgcgcgaacagccctcctcctcctctcgccgcacagcccgccgcctgcgcgggggagcccagcacagaccgccgccgggaccccgagtcgcgcaccccagccccaccgcccaccccgcgcgccatggaccccaaggaccgcaagaagatccagttctcggtgcccgcgccccctagccagctcgacccccgccaggtggagatgatccggcgcaggagaccaacgcctgccatgctgttccggctctcagagcactcctcaccagaggaggaagcctccccccaccagagagcctcaggagaggggcaccatctcaagtcgaagagacccaacccctgtgcctacacaccaccttcgctgaaagctgtgcagcgcattgctgagtctcacctgcagtctatcagcaatttgaatgagaaccaggcctcagaggaggaggatgagctgggggagcttcgggagctgggttatccaagagaggaagatgaggaggaagaggaggatgatgaagaagaggaagaagaagaggacagccaggctgaagtcctgaaggtcatcaggcagtctgctgggcaaaagacaacctgtggccagggtctggaagggccctgggagcgcccaccccctctggatgagtccgagagagatggaggctctgaggaccaagtggaagacccagcactaagtgagcctggggaggaacctcagcgcccttccccctctgagcctggcacataggcacccagcctgcatctcccaggaggaagtggaggggacatcgctgttccccagaaacccactctatcctcaccctgttttgtgctcttcccctcgcctgctagggctgcggcttctgacttctagaagactaaggctggtctgtgtttgcttgtttgcccacctttggctgatacccagagaacctgggcacttgctgcctgatgcccacccctgccagtcattcctccattcacccagcgggaggtgggatgtgagacagcccacattggaaaatccagaaaaccgggaacagggatttgcccttcacaattctactccccagatcctctcccctggacacaggagacccacagggcaggaccctaagatctggggaaaggaggtcctgagaaccttgaggtacccttagatccttttctacccactttcctatggaggattccaagtcaccacttctctcaccggcttctaccagggtccaggactaaggcgtttttctccatagcctcaacattttgggaatcttcccttaatcacccttgctcctcctgggtgcctggaagatggactggcagagacctctttgttgcgttttgtgctttgatgccaggaatgccgcctagtttatgtccccggtggggcacacagcggggggcgccaggttttccttgtcccccagctgctctgcccctttccccttcttccctgactccaggcctgaacccctcccgtgctgtaataaatctttgtaaat

SEQ ID NO: 1406 - DNA, 3338 bp, Homo sapiens
acttccggtgcttgccctgcccatccccgtggcgggggcgtggccatggcgggggcgctccggcgggggcgggccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagcccggcccaccatggacccctctgcccacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggacgttg

SEQ ID NO: 1407 - DNA, 2191 bp, Homo sapiens
ggacgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttg

SEQ ID NO: 1408 - DNA, 3991 bp, Homo sapiens
gtcgcggccttcgccgccgccaacggggctgtccctgtagctcccgatggagtttgaggtcgtgaaacctccgccgagctctgccccggcgagacgaggcgcctccgtcgccaagccgcgccgtcgcggggctcccgggagcggcccttagcgaccccgcccgggccccctcagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagagttacagagtgattatacagaagatgcaacagatactaaacctgatagggatatcgagttagagctttcagcacttgatactgatgaacctgatggacaaagtgaaccaattgaagagatcttggacatacagcttggtatcagttctcaaaatgatcagttgctaaatggaatggcagtggaaaatgggcatccagtacagcagcaccaaaaggagccaccaaagcagaagaaacagagtttaggtgaagaccatgtgattctggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatg

SEQ ID NO: 1409 - DNA, 8695 bp, Homo sapiens
gctggcggagcccgggaggcggagaaggctgtcgttgccttggccgtcgcatccccgagggagtcgtgtcggcgccaccccggcccccgagcccgcagattgcccaccgaagctcgtgtgtgcacccccgatcccgccagccactcgcccctggcctcgcgggccgtgtctccggcatcatgtgtggtatatttgcttacttaaactaccatgttcctcgaacgagacgagaaatcctggagaccctaatcaaaggccttcagagactggagtacagaggatatgattctgctggtgtgggatttgatggaggcaatgataaagattgggaagccaatgcctgcaaaatccagcttattaagaagaaaggaaaagttaaggcactggatgaagaagttcacaagcaacaagatatggatttggatatagaatttgatgtacaccttggaatagctcatacccgttgggcaacacatggagaacccagtcctgtcaatagccacccccagcgctctgataaaaataatgaatttatcgttattcacaatggaatcatcaccaactacaaagacttgaaaaagtttttggaaagcaaaggctatgacttcgaatctgaaacagacacagagacaattgccaagctcgttaagtatatgtatgacaatcgggaaagtcaagataccagctttactaccttggtggagagagttatccaacaattggaaggtgcttttgcacttgtgtttaaaagtgttcattttcccgggcaagcagttggcacaaggcgaggtagccctctgttgattggtgtacggagtgaacataaactttctactgatcacattcctatactctacagaacagctaggactcagattggatcaaaattcacacggtggggatcacagggagaaagaggcaaagacaagaaaggaagctgcaatctctctcgtgtggacagcacaacctgccttttcccggtggaagaaaaagcagtggagtattactttgcttctgatgcaagtgctgtcatagaacacaccaatcgcgtcatctttctggaagatgatgatgttgcagcagtagtggatggacgtctttctatccatcgaattaaacgaactgcaggagatcaccccggacgagctgtgcaaacactccagatggaactccagcagatcatgaagggcaacttcagttcatttatgcagaaggaaatatttgagcagccagagtctgtcgtgaacacaatgagaggaagagtcaactttgatgactatactgtgaatttgggtggtttgaaggatcacataaaggagatccagagatgccggcgtttgattcttattgcttgtggaacaagttaccatgctggtgtagcaacacgtcaagttcttgaggagctgactgagttgcctgtgatggtggaactagcaagtgacttcctggacagaaacacaccagtctttcgagatgatgtttgctttttccttagtcaatcaggtgagacagcagatactttgatgggtcttcgttactgtaaggagagaggagctttaactgtggggatcacaaacacagttggcagttccatatcacgggagacagattgtggagttcatattaatgctggtcctgagattggtgtggccagtacaaaggcttataccagccagtttgtatcccttgtgatgtttgcccttatgatgtgtgatgatcggatctccatgcaagaaagacgcaaagagatcatgcttggattgaaacggctgcctgatttgattaaggaagtactgagcatggatgacgaaattcagaaactagcaacagaactttatcatcagaagtcagttctgataatgggacgaggctatcattatgctacttgtcttgaaggggcactgaaaatcaaagaaattacttatatgcactctgaaggcatccttgctggtgaattgaaacatggccctctggctttggtggataaattgatgcctgtgatcatgatcatcatgagagatcacacttatgccaagtgtcagaatgctcttcagcaagtggttgctcggcaggggcggcctgtggtaatttgtgataaggaggatactgagaccattaagaacacaaaaagaacgatcaaggtgccccactcagtggactgcttgcagggcattctcagcgtgatccctttacagttgctggctttccaccttgctgtgctgagaggctatgatgttgatttcccacggaatcttgccaaatctgtgactgtagagtgaggaatatctatacaaaatgtacgaaactgtatgattaagcaacacaagacaccttttgtatttaaaaccttgatttaaaatatcaccccttgaagcctttttttagtaaatccttatttatatatcagttataattattccactcaatatgtgatttttgtgaagttacctcttacattttcccagtaatttgtggaggactttgaataatggaatctatattggaatctgtatcagaaagattctagctattattttctttaaagaatgctgggtgttgcatttctggaccctccacttcaatctgagaagacaatatgtttctaaaaattggtacttgtttcaccatacttcattcagaccagtgaaagagtagtgcatttaattggagtatctaaagccagtggcagtgtatgctcatacttggacagttagggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgtgttttcatctcctaaaagtggtttttatttccttgtatctgtagtcttttattttttaaatgactgctgaatgacatattttatcttgttctttaaaatcacaacacagagctgctattaaattaatattgatatattcagtattctcttcaactttgtcacgaggaagaatttcctgtagttaattttaactttccttcattacattgttgcataaaactagtcccttagtgccagtttggaagttacttgcaattgtttggaagatttgcaggtcgctgacctcatcatttcactctaagtatatgtggtaggctaagctcagaaaaaggtatgtatgctttacactgataggcaccaaatttagtattgtatcctaagtatttttcctcttctgtattttctgtgctctacccctgaaatatatttaggaataaagaagatataaataaagtgatattggggtatgttcagcttgtaagtgtcagaaatggaagttgacaatttggattaaaatatttaaagtagaatgttattatttgatacccccaaaattgtgagtaataatttcttaatggagcttttctggccagatcttcagggctataggagagtgtgtttgtttttggtgaagtccttctttttcaaaggtttttacttttaaattgtgaagataagctatttagcacaattatttaagtaagctgttttttcctttcttttctttcttttcttgttttaacttctgggtgaggttaagattttctaatagttattgttgttgccagagaagcatagaattctgcttgtgtcttagggttagagaaagatttgttatattttgaggtaatttggaaggactttcatacatggtgactagaaacctgatctttttaagaataaaatagggtcactatttacattatatataatatatggctattatagctatattaatctactttaattgtttctaagattattttgtgtaagtcagctagcgtgtgtatagtgtcatttcttatgttttgtatattaacgttttacaaacacaatttgtgtgggtttgtagcatttcttatagtttaaagtatgattcagcattctaagttaaaactaatatgtgaagtcagtcattagtctgcataatctctgtctccctctgtgtgtgtctttctataaagcacatgtgtacacacacacacacaaatatactgaaagctagggtaagttctaaactgaatatcaaaaaccaaaatcaagaacaaagaagtgatattttccaaacaaacatggattctctgccgggtgcagtggctcagcctgtaataccagcctccactttgggagtctgaggtgggagtattgcttgagctcaagagttggagaacagcctgggcaacatggtgagacctggtctttacaaaaatttttttggccggacgcagtggctcacacctgtaatcccagcactttgggaggccgaggcaggttgatcatgaggtcaagagatcgagaccatcctggccaacatggtgaaaccccgtctttactaaaaatacaaaaattagctgggagtggtggcgtgcgcctgtagtcccaactacttgggaggctgaggcaggagaatcgcttgaacccaggaggcggaggttgcagtgaggcgagatcacgccactacactccagcctggcgacagagcaagactctctcaaaaaaaaaaaaaaaaaattttttttttaaatgggctgggcatggtggcttgtgcctgtagtctcagcaacttgggaggcttaagtagtaggatcgcttgagcctgggaggttgaggctgcagtgagctgtgattgtgccactgtgcttcagcttgagtgacagagtgagaccctcctgactcaaaacaaaaaacatggtttctcctctctctcctgtcttcttactctctatcccatttgatgtagtgatttttaaatgcttttgtaagttaattcttaacacaaaagagacattgtaatgaggcacaccactaaagtgagcatgcccaattaaaaccagtgtaatataggataagaaaatctgatttttcaaaaaagatactctacataaagaatccttcatataaaaagttctttcttgtagtacatttaaagttttaattcactcatgtataactgagagttcctttgagccctttttaggcagggaggcatgtctgtcatctagcgtgtggcccagtaagtgattattacattggaatcagtttttcagtcttttaaaataaattctgtgccataagaataaaagataaagagaaaaattaatgttaactatttttagcttattataactatgtcaacaagtgtttattaatacctattatgggaaagtcactgtggttggcattgaaaattacatcatctttaaagcagtatttgtccccagatggactcatcactagcaaagactaggttcattggaaggcatagggtgagagaatgggaagatgaagtggaggcgggttgttaaagtgctgtcagtgagtgattttgtctacttgaataatggtccatgtttgggggcatattgtgtttcataagaagtgaaaggtatttgcaaagtaagctacaaatgacccataaatctgttaacaacagtccttaatatgcaaagatgaaaaacaagcattactgctacccaaagggaactggtgcttggtgatgtgcagatggggctgttggttaagagagctattacaggttttctctcttaggtttcataggaggtagttactgagatgagattgttttatctttttgaatacagatctcttgtcttgagttagttctgaggatgggagtaataaaggagttttttgtttttttgtttgtttgtttgttttggctccttagtaatactcctctgacatttatttctattattcttcaaagaaaggaaaccaactgaaatgtttgctttaacaaacattttaataagttctctgggtttttttttccccttttaaaaaaattagcatataccatagcaataaaagaactaatgttaactattgtatgctacaacttaagtgatttttctaaagaagcacaatgtcattgaaagtattattgaaaaggatcatagtcacattgaatttgtgaaggccaaagaaattgaagggagtgatattttcattttatgatattcacatatttagtaaattttgtgtacaagaataccaggcagagtgttttacccatggaaacaggtttcagattactttatttttactgttagagtctcaagtttagaaatgctaacacttaaatcagtttttttctcactatacttgaagattgttaatattttgatatcttcctagcttgatgaatttaaacatatcttcagatctgtgacagtgacagccaataggactgataatattagcttcaaaccaataatatccagggttaaaataaaaatcatagtgaaagtacgattgtaaaattatgctatattaacttttaagtctgtaataacttgacatcaaaatgttatgtaattaccataaataatggctagcgagaacatctttggaaattctcaaattacctttcttactacactgtttgcagaatgaatgtagaaatgatcctgttagctttctgaatgttctgtggttgaatgtgtttttgcttaaataaagcttttggtatttgtttaaattacacttcttgagaagtggaaattttaggatcatctttgctttgtttcagttttgtgatttttgaaatgaatgtttagtttactgagccagttggtcatttcttcctcatgtcgttaagtccagtgagtaagcctgaactgtgaataaattaccaaaaacttgcttagaatttcattttgaagcaatttgctaatatttgaagtgtatacacatttgtagttatgttagaaattgtattgtactaagaatgtaatcaatgtctactttagttgtaaacatttctgatgtcaaaactttattcattactgttgattttaagaataagaaatcactgcctaaatattaccaaaagccactgtctctacccgaacttcccagtttgggaaagaatcgttagataaaacaaaggctctgccctttctgataccaaactccacagatactttctcacatcttttaaaacattttgcaataacatattgtttataggaagtttacggggtatgcaatgattaaaacttttaagtgaattgatagttgcaaaagaaaggataatatttaaggtcagtgagtagcaagacaatctaaagtttctgtaatatctggctctctgttaattatagagcaaagtttcccttacagaatccttttatgaacagcaagctagagtctatccctagtggttatagcacctgctgcgtttttcaggagacagttaggccagggtgatttgaatggatagatgtgctgttttgcctgcttgtagaattcagcccagtctttggtctctctctctctctccctcctccacctctccctctctcttcttctgcaccagagcctaaggctgcgccaccaagatgcgtcattttttccagaggcttcttttttttttttttgagatggagttttgctctgttgcccaggctggcatgcagtgctgcaatcttggctgactgcaacttccacctcccgtgttcacacgagtcttttgcctcagcctctggattagctgggattacaggcacgtgccaccatgcctagctaatttttgtgtttttagtagagacggggtttcaccatgttggccaggctagtctcaaactcctgaccttaagtgatctgcccgccttggcctcccaaagtgctgggattacaggcatgagtcaccgtgtcctgcccagacatatcaaatttgacaggtattgtataccctttggatctttaggaattaatttttgcctctgtcactcagctttgtatattttgaaatggagataagtatagggaggtcttggaaggaaaattgccagaattcccaaaccatgtaacactcattgagaattccagatccattatatctaaagggcaagtgaaggaaacagtattgtgaactgggtataactccttggttcttaactagtacattcttaatctgtgagacccaaaggttgataaacaataatttaagattgtacagtactctaaacgtctgcaaaggtctagatgttatcagtatcactagtttttatttctgccagtagctcccttttaggttacattgttgtcctctttccagtgtcgcatctgtcattggtttttcactatggcaagttcattaaaaagcttgctccattgttatcttcaagtaatgcccataaggagatggaagatatctgagacaattaaggctttagcttctaggcaagagaaataacgttgcattaaatttcaagtttctttctgctagacttgaatgtgtctagccactctaatttatgggggcttttggttttttcctattgtactttgtatgtagaattgttttgaaatatcaagcatatttactttgaatttgaactctttcttaattttgtatttatcctttgaataaaatgtaaatccaatatttat

SEQ ID NO: 1410 - DNA, 3700 bp, Homo sapiens
ccattgaatcccagtcctaacagaagtactgcgaatcttgtggcctcattctgaacaaaagggattagagaagaaaaatctcttgatataaggcttgaaagcaagggcaggcaatcttggttgtgaatattttctgatttttccagaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgaggccactgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgccttcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaattttagaatgtaatatatagaggtatatttagcctcttttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttcc

SEQ ID NO: 1411 - DNA, 2301 bp, Homo sapiens
ggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagattttggctatggaaaggggaaatgttctaagcagagcccgtcaggagcccacgggacacattttggagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcacc

SEQ ID NO: 1412 - DNA, 1130 bp, Homo sapiens
gtgcgcactggcgtgcgagactcggcgggcgctgttgagggagtcgggccgcgactgtggtcgtttttataccttcccgcgcggacgccggcgctgccaacggaagggcgggtagggcggtgcgtgattaggttggcgaaggctctgctgccatgaaggtgaagattaagtgctggaacggcgtggccacttggctctgggtggccaacgatgagaactgtggcatctgcaggatggcatttaacggatgctgccctgactgtcctctccatggagaaagcatttctaggtgtttgggctggtgcccgcagcctgtgcctgtcctgggaggcagggcccatccacaggtgcccatcaacacagcttccccaacgcctgggcagcacaccggatccctgatgtctagggaagagtcttctaggtccccagaccccacccctcctgcccttgatcaagagaccagttcactactcagatgcacgtctccttggtgccttgaccattcatgtgacctttttggcatcacagatcaagtgtctgcagatgggcccagggcctgtaggcaaggtgcccggcgacgactgcccgctggtgtggggccagtgctcccactgcttccacatgcattgcatcctcaagtggctgcacgcacagcaggtgcagcagcactgccccatgtgccgccaggaatggaagttcaaggagtgaggcccgacctggctctcgctggaggggcatcctgagactccttcctcatgctggcgccgatggctgctggggacagcgcccctgagctgcaacaaggtggaaacaagggctggagctgcgtttgttttgccatcactatgttgacacttttatccaataagtgaaaactcattaaactactcaaatcttgctggaggcctctgggtgcctgtgttctcggcatatagatgtggtctcggtgtgttttgatatgaaaactctcatgaataaacatctccgtgaaacgccaaggccctcgtcaaaccctgagtcatgactgggaggagaaggagcaggatcagacggtagagcctggggcatgctcttcaggcatgctcttgcctgctggattgccggcggcggccctgggaccctccctcagg

SEQ ID NO: 1413 - DNA, 9543 bp, Homo sapiens
gtttccggtgttgtgactgaaacccgtcaatatggcggcgatcggccgcggccgctctctgaagaacctccgagtacgagggcggaatgacagcggcgaggagaacgtcccgctggatctgacccgagaaccttctgataacttaagagagattctccaaaatgtggccagattgcagggagtatcaaatatgagaaagctaggccatctgaataactttactaagcttctttgtgatattggccacagtgaagaaaaactgggctttcactatgaggatatcataatttgtttgcggttagctttattaaatgaagcaaaagaagtgcgagcagcagggctacgagcgcttcgatatctcatccaagactccagtattctccagaaggtgctaaaattgaaagtggactatttaatagctaggtgcattgacatacaacagagcaacgaggtagagaggacacaagcacttcgattagtcagaaagatgattactgtgaatgcttccttgtttcctagttctgtgaccaactcattaattgcagttggaaatgatggacttcaagaaagagacagaatggtccgagcatgcattgccattatctgtgaactagcacttcagaatccagaggtggtggcccttcgaggtggactaaacaccatcttgaaaaatgtgatcgattgccaattaagtcgaataaatgaggccctaattactacaattttgcaccttcttaatcatccaaagactcgacagtatgtgcgagctgatgtagaattagagagaattttagcaccctatactgattttcactacagacatagtccagatacagctgaaggacagctcaaagaagacagagaagcacgatttctagccagtaaaatgggaatcatagcaacattccgatcatgggcaggtattattaatttatgtaaacctggaaattctgggatccagtctctaataggagtactttgcataccaaatatggaaataaggcgaggtctacttgaagtgctttatgatatatttcgtcttcctctacctgttgtgactgaggagttcatagaagcactactcagtgtagatccagggaggttccaagacagttggaggctttcagatggctttgtggcagctgaggcaaaaactattcttcctcatcgtgccagatccaggccagacctcatggataattatttggcactgatactctctgcatttattcgtaatggacttttagagggtctagttgaagtgataacaaacagtgatgatcatatctcagttagagctaccatccttttaggagagcttttacatatggcaaacacaattcttcctcattcacatagccatcatttacactgcttgccaaccctaatgaatatggctgcatcctttgatatccccaaggaaaagagactgcgagccagtgcagccttgaactgtttaaaacgcttccatgaaatgaagaaacgaggacctaagccttatagtcttcatttagaccacattattcagaaagcaattgcaacacaccagaaacgggatcagtatctccgagttcagaaagatatatttatccttaaggatacagaggaagctcttttaattaaccttagagatagccaagtccttcaacataaagagaatcttgaatggaattggaatcttatagggaccattcttaagtggccaaatgtaaatctaagaaactataaagatgaacagttacacaggtttgtacgaagactactttatttttacaagcccagcagtaaattatatgccaacctggatctggattttgccaaggccaaacagctcacggttgtaggttgccagtttacagaatttcttcttgaatctgaagaggatgggcaaggctacttagaagatctagtaaaggatattgttcagtggctcaatgcttcatctggaatgaaacccgaaagaagtcttcaaaataatggtttattgaccacccttagtcaacactactttttatttattggaacactttcttgccaccctcatggagttaaaatgctggaaaaatgcagtgtatttcagtgtctccttaatctttgctccttgaaaaaccaagatcacttgctaaaacttactgtttctagcttggactatagcagagatggattggctagagtcatcctttccaaaattttaactgcagctactgatgcctgcagactctatgcaacaaaacatttaagggtattattgagagctaatgttgaattctttaataattggggaattgagttgttagtgacccagctacatgataaaaacaaaacgatttcctctgaagctcttgatatcctcgatgaagcatgtgaagacaaggccaatcttcatgctctcattcagatgaaaccagcgttatcccaccttggagacaagggtttgcttctcctgctgagatttctctccattccaaaaggattttcctatctgaatgaaagaggttatgtagcaaaacaattggaaaagtggcacagggaatacaactccaaatatgttgacttgattgaggaacaactcaatgaagcacttactacttaccggaagcctgttgatggtgataactatgttcgtcggagtaaccaaagattacagcgtcctcacgtctacctgcctatacacctttatggacaactagtacaccataaaacaggctgccatttgttggaagtacagaatattattacagaactctgtcgtaatgttcgtacaccagatttggataagtgggaagaaattaaaaaactgaaagcatctctttgggccttgggaaatatcggctcatcaaattggggtctcaatttgctacaggaagaaaacgtgattccagatatactaaaacttgcaaaacagtgtgaagttctttccatcagagggacctgtgtatatgtacttgggctcatagctaaaaccaaacaaggctgtgatattctaaaatgtcacaactgggatgctgtgaggcatagtcgcaaacatctgtggccagtggttccagatgatgtggaacaactctgtaatgaactttcatctatcccaagcactctaagtttgaactcggagtcaaccagctctagacataatagtgaaagtgaatctgtgccatcgagtatgttcatattggaggatgaccggtttggcagcagctctactagcacatttttccttgatatcaatgaagatacagagccaacattttatgaccgatctggacccataaaggataaaaattcattccctttctttgcttctagtaaacttgtgaagaatcgtatcttaaattcgcttactttgcctaacaaaaaacatcgtagtagcagtgatccaaaaggagggaaattatcatctgaaagtaagacaagcaacaggcgaatcagaacacttacggagcccagtgttgattttaatcatagtgatgattttacacccatatccactgtacagaaaacattacaattagagacttcatttatggggaataagcacattgaagacactggtagtacaccaagcattggagaaaatgacttaaaattcaccaagaattttggtacagagaatcacagagaaaatacaagccgagagaggttagtagtagaaagttcaacgagctcacatatgaagatacgtagccaaagtttcaatacagacactacaacaagtggcataagttcaatgagctcaagtccttcacgagagacagtaggtgtagatgctacaactatggacacagactgtggaagcatgagtactgtggtaagtactaaaactattaagacaagccactatttgacgccacagtctaaccatctgtctctctccaaatcaaattcggtgtccctggtgcctccaggttcttctcatacgcttcctagaagagcacagtcccttaaagcaccctctattgctacaattaaaagtctagcagattgtaactttagttacacaagttctagagatgcttttggctatgctacactgaaaagactacagcaacaaagaatgcatccatccttatctcactctgaagctttggcatctccagcaaaagatgtgctatttactgataccatcaccatgaaggccaacagttttgagtccagattaacaccaagcaggttcatgaaagccttaagttatgcatcattagataaagaagatttattgagtcctattaatcaaaataccctgcaacgatcttcctcagtgcggtccatggtgtccagtgccacatatgggggttcagatgattacattggtcttgctctcccggtggatataaatgatatattccaggtaaaggatattccctattttcagacaaaaaacataccaccacatgatgatcgaggtgcaagagcatttgcccatgatgcaggaggtcttccatctggaactggaggtcttgtaaaaaattcttttcacttgctacgacagcagatgagtcttacggaaataatgaattcaatccattcagatgcctctctgtttttagaaagtacagaagacactggactacaggaacatacagatgataactgcctttattgtgtctgtattgaaattctgggtttccagcccagcaaccaactgagtgcaatatgtagtcattcagactttcaagatattccatattctgattggtgtgagcagactatccataatcctttagaagtggttccctctaagttttcggggatttctggatgcagtgatggggtgtctcaagaaggctcagctagcagcaccaaaagcacagaattgttactaggtgttaaaacaattccagatgatacaccaatgtgccgtatactccttcgcaaagaagttctaagattagtcattaatttgagtagttcagtttcaactaaatgtcatgagactgggcttttaacaattaaggagaagtatcctcaaacatttgatgacatatgcctttactctgaggtttcccatttgctgtcacactgcacattcagacttccgtgtcggaggttcatacaagaattatttcaagatgtacagtttctacaaatgcatgaagaagcagaggctgtgttggcaacaccaccaaagcaacctatagttgatacatctgctgaatcctgacctcatatttatgatggatatagatacatactatatatattcatatttgtggatttcctaaaagcctcagaaaatacgactgactaggcagcaaagacaggagtatcttctgtacactgttccgcagttactggtacatgaacagttggaactgctgactttcctaaccaaaacaacttccttctctcctttgttgagccttttgaggggttcatgattcattaccacagttttaagagtttcagttaccattgtatgcaagagccaagcactgaatacctacataggttttctattttctttcattttaaaagcataatgacagtggaacaataatgggatatgcagaagcacccttcacaagttatttctgaatgatttttagggtaaataatacagatgccttgtttgttaactaacttgtggaaagcaggaatcagtgtctctaaggctgcatcctattaccacaatggggtgtgctataactgctggtattagagagggaactttggccctttcacgtttttcttaatgtttgtaacactacttcagaggtttataacctcaaagcagaagaagagcctcaacaacccgggacttataagttatttttatgttactagacttgcataaagattcttgttttccaactcttcattttgttgcaatgtgttattacaggatatatgaaccaattaaggtttttcactacagttcttgaataaaatttaaaaatcattttttattttaattaaaaatatttcccatttatagaatgcatatatttgcaatggacttccactttcatcaactttccatctcatcgctttaaacaggaacttgaacaagcactgttagtttagacctaaaggataggaaagcattaaataatactttggatctcctgaggaaaagataagtttgcttgcaatttacacattccatggggaaagaagagccatatttccttaaaaaaaacattaataaagcttgttattgagaaaaattgtagtgaaaagccttaagtaccaaattttaaagcagcagtaacttaatttttatatcagtgtttttgttttgcacaaactaaatgcagtggtaggtgggtttatgagtatattaattgcctttatccatttgtgaagttaagttgatgagggcaaggtttttgtttgtttaatttgtatatgtctaaaggtatttggaactttttacaggaattaaacatatatgcaaatttgtatataaaaatagcatggccatcatttgaatgcttgtaaatgaaaggattatcttttttgagatctatatataaatagaaatagaaaatccagctggactgattaggattcttttttaattcatttgtgtataacatttttattacaattacacatcagttttgacacagtcatagcaacattaatattttcccatgatgcagatcctttttgtaatgggcttgttctttgagatctctgtaaagaaccctgtgaactagaaaacataactcacagagatacttttttaaaaaatttatttactggaactgaaagttccagttgggatgaagcatttcatctcacttcataacacctctttgactgcacttcagtgaattgttcttatgtgcactgtgtagcaacttacattataacaaagcagataagggctgtaagctgctgcttatgttgaaaagtggttcttcagattttctctcataaaatccagttgaagataaataatttttttatactttatcactgaacccaagtgtttatttaaatgtcaacagtacttctaagaacgttgcctgtcatcgtggtctttggtcttggataactaaactgcctttccagagaaccaaatgtcagagttactagaccaaatagtggttaaaacctccaaaggaagtaatgtaatcttattcataatgggattaacatattttagacattcattttaaacactacctcagttaatatagagtataaaaatctgtggtttaatccctcaaaagttaacagtaattttttttttgtcttacacacacacacaccccctcccccaccatcactatccctgtaccctcaccttggtcatctatcctgaaataaggcttagttagtattggcctgaatgttttgtgtttttttttttgttttttttttttactgttactttgaaaaatatgtatgtataccttatcatatctgcctatatcacttactttggggagatactcagagctttgtggttatcagtatactaaaaaaaaaaaaaagtctacgcttaaatttatagtgctatttggtttctccatgatttcactgacaggtctaatacattttctttgagtacttgtttgtaaaaagtagactttatggtgaaaaatacatgcagtgccaagtgattaacttaagtgtttaaaaatattaaattatagcagaagaggttaggaatgatatcagcagtaatagaaataattgagaaaatcatctataaataatagatattacagactatagaataccaaaataatgtcaatactgtagtttttaaagattttaggattaatcttagtccatataaatttgtactattggtaattattgaataattgggaggaatctgggcagttgtgctggttgtaaactatgaatttctaatcgtaaagtgaattgttatttctaattgaactttttttcaagaacagatttcagcctcacatactaagtaaatactgataaataaggaaattagaaatttagtattcataattaaatatgctctaaaatttcctatacttttatttcctgtttattcttaggtagattggaagggggaaacagtctgttctccctaattaaattttttctaataacgattagtagaatatggacattctatatgacagtgacattaaaagaggctctttggaagtatatacattattaacataatgtgtacaagtccttttgaaatgacaactttaatgggtttcagctcttttatctagagcttgagataattcaagctgagtttttcagggcatatcacaacggccaagtgttcagcagtgggatatcaatgcttatttacattttcctactgctatttatataaaatgttattccattcagaggatgccttttatccccacattaaagcacagatcattaagcaataaaaaccaaattgtctgtcattcaaattataactgcagttatttttgcatggtaagagtgaggtgctaattttgtgtgagatgaactttgtaaactactttgggaaatgttctttggaagtaaggttttttctcctttagtcttatgcttccacttttgtctcagattcacaatccattaaaacatggggaaaaaagaaaaggtaaaattgagagacttttgttagaggagctatttggaatgaaccaacatttcagattttccaaaatgtaagttaggaagtctccattgtctctgcattaacaaaatacactgttactatcttaatctcaagagtgtcattacagtgagaatctcatttaaaagcataccagtgaaattaatagcagtgcttatcaaagaacactgaaatctgtgagaatctttctaggagcattcttttcttcttttagttccaagttccagggtatttttcattcctagtaggtttatatgactcacagaatgtggacttttttcctgtttggagtatttttgtaatgtaagtatcggatagctgcaccacagcatgcataaattgcacattttgttttactttctttatagaatatttaatttcaaaaatataatttatgccaaaaaaagcatacctttcaattttgctacttggttgatttagcacaaaatgcaaagtcttggggcagagagggggagtgaaaaaaattttataggtaattgttacaaaaatacctgtcagaaaccctaaagctgcattgtaaaacaaatggtgtaaactagttttgaaaagtggtaaggaattgtgaaaaaaatctcagacttaatgctctctaaccacatgagtttcttcttttttatttagtaatacgctgctacatatttggaggttctggtgtttgtaggtcactgaacagacattgaaatctgatttatattgtataactgtaacatagaaagaaaaagtatttatattttttctgtaagaatatttcattgagttgtgtataatttaaataagatttgtccccaaatggttttgctcaccttgattttttttgttgtgattttcttgtttttgtataatgtgtatagtttatgtcaagggcattaaaagcctcctgaagcataatcttatcaaagggatacattgttaataaaatgtacttaaaattcttaaac

SEQ ID NO: 1414 - DNA, 5471 bp, Homo sapiens
gccctcttctgaagaggcgtttctggaccactgagccccgcctcccactgtgagcggaaccctaccgtttttaaaaaaatctttttcaaaacttgccaggttgtctttccaaatatttttaataatagtgctgctgctgtagaccacagagaaaagaatccctcgctcttccttttcacttagtagaaacttctaccgcgtaggtcccgccaggagttcgcgcatgcgcaggagcgacaataagatggcggtgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaa

SEQ ID NO: 1415 - DNA, 4155 bp, Homo sapiens
atgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggcttaacagagcgttccaaaaagaggactctccagctactttttattgcatcagtatgcagtggtttagagaatgggaaagttttgtgaagggtaaagatggagatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgt

SEQ ID NO: 1416 - DNA, 2852 bp, Homo sapiens
aacctgtggacggccgcggccggcggacacacagcagcgggggcccggccgggggtcgcccgggggcccggaagccggggaagagcgaggaaaccaacttggagagaggagtgacctgggggccgggggcggagtcgtgagcgggggaggagagagccggccgccagcaagagccgcgcggcggcccaggaagcgagagcgccgcccacccatccggggcaagagccgcgccgcaggagaggcaggctggaccgggggctccccgggcccgcgacccccgccgtgaccccgcagcccccagctcgcccccaagatgatgaagaggcagctgcaccgcatgcggcagctggcccagacgggcagcttgggacgcaccccggagaccgctgagttcctgggtgaggacctgctgcaggtagaacagcggctggagccggccaagcgggcagcccacaacatccacaagcggctgcaggcctgtctgcagggccagagcggggcagacatggacaagcgggtgaagaagcttcccctcatggctctgtccaccacgatggctgagagcttcaaggagctggaccctgattccagcatggggaaggccttggagatgagctgtgccatccagaatcagctggcccgcatcctggccgagtttgagatgaccctggagagggacgtcctgcagccactcagcaggctgagtgaggaggagctgccagccatcctcaaacacaagaaaagcctccagaagctcgtgtccgactggaacacactcaagagcaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggacgagtacttggctgacctgtaccactttgttaccaaggaggactcctatgccaactacttcattcgtctcctggagattcaggccgattaccatcgcaggtcactgagctcgctggacacagccctggctgagctgagggagaaccacggccaagcagaccactccccttcgatgacagccacccacttccccagggtgtatggggtgtcgctggcaacccacctgcaagagctgggccgggagattgccctgcccatcgaggcctgcgtcatgatgctgctttctgagggcatgaaggaagagggtctcttccgtctggctgctggggcctcggtgctgaagcgtctcaagcagacaatggcctcggacccccacagcctggaggagttctgctccgacccgcacgctgtggcaggtgccctcaagtcctatctgcgggagctgccagagcctctgatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctctgaggaacttccgtccactgccgtgcccaccccagccaccaccccggctccggctccggctccagctccagctccggccccagccttggcttcagcagctaccaaggaaaggacagagtctgaggtgcctcccagaccagcctcccccaaggtcaccaggagtcccccggagacagctgccccagtggaggacatggctcggaggaccaagcgcccggcgccagcccggcccaccatgccgcccccccaggtctccggctcccgctcctcccctccagccccgcccttgccccctggctctggcagccctgggaccccccaagccctgccccgacgtctggttggcagcagcctccgagcccccacagtgccacccccgttaccccccacaccccctcagcctgcccggcgccaaagccggcgttcaccagcctcccccagcccggcctccccaggtccagcctcccccagcccagtctctttgagtaaccctgcacaggtggacctgggggctgccacagcagagggaggagcccctgaggctatcagtggggtccccactcccccagctatcccccctcagccccgccccaggagccttgcctcagagaccaactgagtggctggtttctccctaagcagccctcagcaccccctccctccccacctggccctcccaggacagctctcgccccccacaaaggggcatgggcctccagcctttgcccacaagtgcctcagtgcccactgggtcggcccccatggccaggagggctcaggacaatcctctatttcctgaccttttcctcgtccaccctgggcttggggacccccccaccggactctccactctccggcaggtcctaggggagccaccggaaggaaggagaggtttgcctgctcctacgggactgattcttctcttgccgacatgttttttgtaaggctggtaaataaattattttggacaaaactggagcagctgcccaaatgatagttttattttctgtccttgaaataaagaagccaattttataaaggggaaaacaata

SEQ ID NO: 1417 - DNA, 2605 bp, Homo sapiens
ggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaagcaacagatgaaatttagtcttacaccgagacagactattcacctagttaaatatgaagggtctatgaaggtctccatgacaccctgtaaccagctgcaatttgacattagacttgatgttctgattacttatactttttgttttagttcctttcctgagcctgaattgtacaaatatgtcctaaaacaccaacttattaagaggcttaatgcctgttaaatgcgtcagtgctcttggcagcttagcatgagtgctttctttgcatgggaggttgcagtttagaagcaactttatggatcatttcccaggttgatgttacatatgttcattttacaacctgtgtgcataatctctcagggtgaaggtaattaagagaaagcataatctacagaattgaagccaagtaatctaagattctgtttttaaactctttgctatataacattagttaagttgtttaccctcttaatttatccatttgtaaaatgatagtttttgtttttaaagtgctctattacccttactttaaaagtcctgtctaccatatatttaaaactataagtggaaataatgaagaaactctgaacttgcttttgcttatatatggatatatcatattatatgcctaagattggagataaattttataacctgattttctcatggcagtgtacaaatgaaattattctgtaagtttttcaaaacagtaaaatcactatttttca

SEQ ID NO: 1418 - DNA, 6815 bp, Homo sapiens
gaacgctcacagaacaggcagtgcaattccatgttcctcttaagtatgttagccctaccgggagctgagctggccagtctacttggagaggaaaagtagatctggggaaggtggaagggtcagttcctaagtgacttcctcctcggggatggtaagggcatttgctgatctccagtgactgcctggtgcctcatggtcagactcggctgtctcactcccagatatctgattttgcaaaaagggacacacctatctgcagcaaagaagacactgaccagattgcgagcggtgcttttggatgctctgtagccacccggggcccaggaggactgactcggcagcaggattcgtgcatgggaatcggagaccatggcagtgcagctggtgcccgactcagctctcggcctgctgatgatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgagctcacgggcaagctgccagtagaatatcccctggatccaggggaggaaccacccattgttcggagaagaataggaacagccttcaaactggatgaacagaaaatcctgcccaaaggagaggaagctgagctggaacgcctggaacgagagtttgccattcagtcccagattacggaggccgcccgccgcctagccagtgaccccaacgtcagcaaaaaactgaagaaacaaaggaaaacctcgtatctgaatgcactgaagaaactgcaggagattgaaaatgcaatcaatgagaaccgcatcaagtctgggaagaaacccacccagagggcttcgctgatcatagacgatggaaacattgccagtgaagacagctccctctcagatgcccttgttcttgaggatgaagactctcaggttaccagcacaatatcccccctacattctcctcacaagggactccctcctcggccaccgtcgcacaacaggcctcctcctccccagtccctggagggactccgacagatgcactatcaccgcaacgactatgacaagtcacccatcaagcccaaaatgtggagtgagtcctctttagatgaaccctatgagaaggtcaagaagcgctcctctcacagccattccagcagccacaagcgcttccccagcacaggaagctgtgcggaagccggcggaggaagcaactccttgcagaacagccccatccgcggcctcccgcactggaactcccagtccagcatgccgtccacgccagacctgcgggtccggagtccccactacgtccattccacgaggtcggtggacatcagccccacccgactgcacagcctcgcactgcactttaggcaccggagctccagcctggagtcccagggcaagctcctgggctcggaaaacgacaccgggagccccgacttctacaccccgcggactcgtagcagcaacggctcagaccccatggacgactgctcgtcgtgcaccagccactcgagctcggagcactactacccggcgcagatgaacgccaactactccacgctggccgaggactcgccgtccaaggcgcgccagaggcagaggcagcggcagcgggcggcgggcgcactgggctcagccagctcgggcagcatgcccaacctggcggcgcgcgggggtgcggggggcgcggggggcgcggggggcggtgtgtacctgcacagccagagccagcccagctcgcagtaccgcatcaaggagtacccgctgtacatcgagggcggcgccacgcccgtggtggtgcgcagcctggagagcgaccaggagggccactacagcgtcaaggctcagttcaagacgtccaactcctacacggcgggcggcctgttcaaggagagctggcgcggcggcggcggcgacgagggcgacacgggccgcctgacgccgtcgcgatcgcagatcctgcggactccgtcgctgggccgcgagggcgcccacgacaagggcgcgggccgtgccgccgtctcagacgagctgcgccagtggtaccagcgttccaccgcctcgcacaaggagcacagccgcctgtcgcacaccagctccacctcctcggacagcggctcgcagtacagcacctcctcccagagcaccttcgtggcgcacagcagggtcaccaggatgccccagatgtgcaaggccacgtcagctgccttacctcaaagccagagaagctcgacaccgtcaagtgaaattggagccacccccccaagcagcccccaccacatcctaacctggcagactggagaagcaacagaaaactcacccattctggatgggtctgagtctccacctcaccaaagtactgatgaatagaggagctacaatgatagctgtttcctggattcctccctctatccagaactagctgatgtccagtggtacgggcaggaaaaagccaagcccgggaccctcgtgtgagccagcccggcctaatctgaccgcctcaacgccattctgagatcacctcactgcctctcatttgccttacccagacgcaccgtcaccctgcaccagctttggccctcagcactttttttctcctgtctccgcattccctcccccttgaaaacctgactgaggagacattctggaaggttccggtcccactgtgtgtcccctggcgctcttgcccatagagagccagacaccaatcctcaatggcaccttggtggcttccctctgccatgacagcccctaggccaggaaccatcaggggggccagccggcatccaattcctgcggataagtagcgttgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgcatcggaggaccacaatcagttctatgctgccaaagattaaaaataaataaaaacataaaaaattaagaggggccaagaggaagacattctttctgcaaggaaatttcttttaaattctgaactgctactacacacaagtgaaagtcaaccctatgtaaactggtgtcctctctctagccctctcccttactggcccacttctctctccgtagagagcctgaaaaactgccccaatgccacggtaaaggcgaggaagtcttggctggcgttgctgactcacagtcgccatccatctggacacaaagagagacctgtgggagtcgtagagggtactgttagccccggtccatgcagggggttcagccgagcccaagactcaaagctgctttcctttcaggatttgtagtaacgtaaggtgataatggccaaaagtggttctctctcattaaaccaaccagtaaaagcgtatcctatttttttgcacaaggtgtttcattttcgtttttatgggaaaccaagggaaaagcacattgcgatccattcagtgtttaactgtcgtggctcattttctgttcgttagcacttgtgtgacaaaagagctcagatccgacttctcctatgtgtcacttattccaagaacccaactatgcccttaggtagaaagatttgactcgtgtgtctactagccaacaggcagagcagggttgaaaaaaatatcagctcccaaagggcccatgtgtctacatcatcagttactgtcatgcaccacatttgtgtgcagataccaaaagaggaggaaagaagaaaaaaattaatgtgtgggagctgcacgtttacatgttttgagctatgcttcaaacacaactggaaagccatcaatcttcaaaggcctcaaaaatacttttatagtaacaagtgcacgactttagttgggttattcaagatggcacaaaaaggtttccgcagaggtggtatgctgtgcttttggcgcaagtggtggggggatggggtgggggtggaatttttttctcactctaatgacttcctattggaaaggcattgacagccagggacaggagccagggtgggggtagttttgtgggaaagcagaactgaagttagcttaagcataaaaacaaagaaaaatcttcgcttttcatgtatgtggaatccaagaataaccataggctctaccagaccagaagggtaaggatggacactaaaatgaaacaaataccaaggtattccttctgctgcagcctggagaccaccgagagtcgagctggggcacacacacacctggccgggacccggcagggacaaggcgggccgtggcctcctccaccaagtctctctagacaattcagggcctgctttccccagctccatgcatggctggactggtgattccagggtgcagaagggattcatattcccagaacgctttaagtgtacacctgcaggataaagagataccggttacattattaaatgattctagggattcactgggggatatttttgttgcttttactttcatggttagagctacaaagaacagtgattttttttttttctcccttccccattcagaaacattatacattgggccatttttctttctcccaaagaagattcatggatagtcagactgaactgtgtgcaacaggaaaagtcaaaagggaaaaggtagctgatgaggttacatggttacatgttctacatcatgcatagtagcttgaaatctagtctggagaaaactggatcaagattctagcccactggagttgcaaggaatgagaggcaaaaattctaaagatttgggttatattttcaacttgggggacagagagaaatggagagcaggaattacagttccaacaaacatcatgatagtctggtagtcaagacagagattaagtaaaacaggttttactgtttagctgagttcagttaatacaaaatgtacataaaacgttagtcctttgagactgacatgattaatgatcagtgtggtgggaaatgatgtagttattgtacacaagcacttgcaaactctttatccctatttctttaaaacaaaataaggtgaaatacgaagtccttggtctgatataaagcccctattggattcttcggatgcgtaaaagaaattgcctgtttcagccagaagactggtgaaaacacatacatcagactatgttgtgagccaggttgattttttattttattatatgcaggtgagtgttgaaactgttaaaattccaatttgttttcattcagtattagtttagttctaaatatagcaaaccccatccaggtgctatcagatgaccagttactgcttagttaactaggtgtaaagttttacatatacattaatgtcaatagtttattacaagttgtgtaaaatggactctagtttaataatgggggaaaaaagattaggttgctcctgaaactgactgtagagcatgtaaaatgattttactggattctgttcaactgtaatcaatgaaaaagatgtacgttgtagacaaagttgcagaattaaaaaaagaaatctgcttttaatttattctttttgtattaagaatttgtatagtacctttacattttgcaaaacagtgttgtcaacacttattaaagcattttcaaaatg

SEQ ID NO: 1419 - DNA, 4031 bp, Homo sapiens
gattggaaacccggagttacctgctagttggtgaaactggttggtagacgcgatctgttggctactactggcttctcctggctgttaaaagcagatggtggttgaggttgattccatgccggctgcctcttctgtgaagaagccatttggtctcaggagcaagatgggcaagtggtgctgccgttgcttcccctgctgcagggagagcggcaagagcaacgtgggcacttctggagaccacgacgactctgctatgaagacactcaggagcaagatgggcaagtggtgccgccactgcttcccctgctgcagggggagtggcaagagcaacgtgggcgcttctggagaccacgacgactctgctatgaagacactcaggaacaagatgggcaagtggtgctgccactgcttcccctgctgcagggggagcagcaagagcaaggtgggcgcttggggagactacgatgacagtgccttcatggagcccaggtaccacgtccgtggagaagatctggacaagctccacagagctgcctggtggggtaaagtccccagaaaggatctcatcgtcatgctcagggacactgacgtgaacaagcaggacaagcaaaagaggactgctctacatctggcctctgccaatgggaattcagaagtagtaaaactcctgctggacagacgatgtcaacttaatgtccttgacaacaaaaagaggacagctctgataaaggccgtacaatgccaggaagatgaatgtgcgttaatgttgctggaacatggcactgatccaaatattccagatgagtatggaaataccactctgcactacgctatctataatgaagataaattaatggccaaagcactgctcttatatggtgctgatatcgaatcaaaaaacaagcatggcctcacaccactgttacttggtgtacatgagcaaaaacagcaagtcgtgaaatttttaattaagaaaaaagcgaatttaaatgcactggatagatatggaagaactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaacaagacttaaagctgacatcagaggaagagtcacaaaggttcaaaggcagtgaaaatagccagccagagaaaatgtctcaagaaccagaaataaataaggatggtgatagagaggttgaagaagaaatgaagaagcatgaaagtaataatgtgggattactagaaaacctgactaatggtgtcactgctggcaatggtgataatggattaattcctcaaaggaagagcagaacacctgaaaatcagcaatttcctgacaacgaaagtgaagagtatcacagaatttgtgaattactttctgactacaaagaaaagcagatgccaaaatactcttctgaaaacagcaacccagaacaagacttaaagctgacatcagaggaagagtcacaaaggcttaaaggcagtgaaaatggccagccagagaaaagatctcaagaaccagaaataaataaggatggtgatagagagctagaaaattttatggctatcgaagaaatgaagaagcacagaagtactcatgtcggattcccagaaaacctgactaatggtgccactgctggcaatggtgatgatggattaattcctccaaggaagagcagaacacctgaaagccagcaatttcctgacactgagaatgaagagtatcacagtgacgaacaaaatgatactcagaagcaattttgtgaagaacagaacactggaatattacacgatgagattctgattcatgaagaaaagcagatagaagtggttgaaaaaatgaattctgagctttctcttagttgtaagaaagaaaaagacatcttgcatgaaaatagtacgttgcgggaagaaattgccatgctaagactggagctagacacaatgaaacatcagagccagctaagagaaaagaaatatttggaggatattgaaagtgtgaaaaaaaggaatgataatcttttaaaggctctacaattgaatgagctcaccatggatgatgataccgctgtgctcgtcattgacaacggctctggcatgtgcaaggccggctttgcgggcgacgatgccccccgggctgtcttcccttccatcgtggggcgccccaggcagcagggcatgatggggggcatgcatcagaaagagtcctatgtgggcaaggaggcccagagcaaaagaggcatcctgaccctgaagtaccccatggaacacggcatcatcaccaactgggatgacatggagaagatctggcaccacaccttctacaacgagctgcgtgtggctcccgaggagcaccccgtcctgctgaccgaggccaccctgaaccctaaggccaaccgcgagaagatgacccagatcatgtttgagaccttcaacaccccagccatgtacgtggccatccaggctgtgctgtccctgtacacctctggccgtactactggcatcgtgatggactctggtgacggggtcacccacactgtgcccatctatgaggggaatgccctcccccatgccaccctgcgcctagacctggctgggcgggaactgcctgactacctcatgaagatcctcaccgagcatggctataggttcaccaccatggccgagcgggaaatcgtgcgtgacatcaaagagaagctgtgctatgttgccctggacttcgagcaggagatggccacggtggcctccagctcctccctagagaagagctacgagctgcccgatggccaggtcatcaccatcggcaacgagcggttccgctgccccgaggcgctcttccagccttgcttcctgggcatggaatcctgtggcatccatgaaactaccttcaactccatcatgaagtctgatgtggacatccgcaaagacctgtacaccaacacagtgctgtctggcggcaccaccatgtaccctggcatggcccacagaatgcagaaggagatcgctgccctggcgcctagcatgatgaagatcaggatcattgctcctcccaagcgcaagtactccgtgtgggtcggtggctccatcctggcctcgctgtccaccttccagcagatgtggatcagcaagcaggagtatgatgagtcaggcccctccattgtccaccgcaaatgcttgtaggtggactctgacttagttgcgttacaccctttcttgacaaaaccaaacttctcagaaaacaacatgagattggcatggctttatttgttttcttgtttcattttttgttttgttttttattggcttgactcaggatttaaaaaccggaatggtgaaggtgacagcagtcggttggaggaagcttcctccaaagttctacaatgtggccaaggactttgattgtaccttgttcttcttttcaatagtcattccaaatattgtgagacgcattgtttcaggaagccccttgccctgctaaaagccaccccacttctctctaaggagaatggcccagtcctctccctagttcacacaggggaggtgatagcattgcttttgtgcaaattacataatgcaaaattttttgaatcttcgccttaatactttttaattttgttttattttgaatgatcagccttcgtggcccccctcttttgtaccccaacttggggtgtatgaaggcttttggtctccctgagagtggctggaggcagccagggcttacctgtactctgacttgaggagagttggataaaagtgcacaccttaaaacaaattgaggaagcacagtatttcagtacagtggacagcttagcatgttgacaactgagaataaaatgctcagttctgaactggacaatgtaagacacaacgaggaaacactggaaat

SEQ ID NO: 1420 - DNA, 2563 bp, Homo sapiens
ctcccctgctgcagcaaggccctcccccatccgcacacacaggctgctgggtaagtggcaagatggctcccctgcatgtctccggctgatcgctgccgctccgccaatacaatagagccagccactaccagcagcctggccctcttcctccttctccagagagaccaatccagccgaactcggggtttgccaaagggataaacagcacttccagggggagaaaaaaaatcatgttatcagaaagcaaagaaggtgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagtttt

SEQ ID NO: 1421 - DNA, 1348 bp, Homo sapiens
ttttctgcccgtggacgccgctgaagaagcatcgttaaagtctctcttcaccttgccgtcatgtctaagtcagcgtctccaaaagagcccgaacagctgaggaagctcttcattggagggttgagctttgaaacaactgatgagagcctgaggagccattttgagcaatggggaacgctcacagactgtgtggtaatgagagatccaaacaccaagcgctccaggggctttgggtttgtcacatatgccactgtggaggaggtggatgcagctatgaatacaacgccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtaattgaaatcatgactgaccgaggcagtggcaagaaaaggggctttgcctttgtaacctttgacgaccatgactccgtggataagattgtcattcagaaataccatactgtgaagggccacaactgtgaagttagaaaagccctgccaaagcaagagatggctagtgcttcatccagccaaagaggtcgaaggggttctggaaactttggtggtggtcgtggagatggtttcggtgggaatgacaactttggtcgtggaggaaacttcagtggtcgtggtggctttggtggcagctgtggtggtggtggatatggtggcagtggggatggctataatggatttggtaatgatggaagcaattttggaggtggtggaagctacaatgattttggcaattacaacaatcagtcttcaaattttggacccatgaagggaggaaattttggaggcagaagctctggcccctatggcggtggaggccaatactttgcaaaaccacaaaaccaaggtggctatggcgtttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagtgttttaatgtagatttttttttttgcacccatgctgttgattgctaaatgtaatagtctgattgtgacgctgaataaatgt

SEQ ID NO: 1422 - DNA, 4335 bp, Homo sapiens
gatacttgctgtaagtagcaaaaagatgggaaggaaagtctacagaccaaatcatatctgaatctccccattctccctctccacaaatattggtttaggaattctccgaagtttgaaggttatgaatggttatcactcaaggattcagaactaagcagaggaaagaaattcctaagggaacactgctcagaaagtactgcagcatgtcttcaaatgcctgaggatcaagttggaaaactagaagcaacagaaaacacaataagccccaggcgtgagtcactggagagcgcgacgggaggaaggggcgccctgagtccacagccctgggggaggtcggagggtctgaaagcgagaagtccgtgagtagaagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacaggcggtaaatgactcgtgctaccagaatgatgattctgtcctaaaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcctgactggaaataccggcatgcaggattgatggccttatctgccattggtgaagggtgccaccagcaaatggaaggaattctaaatgagatcgtaaattttgttttactttttctccaggatcctcatccaagagtaaggtatgcagcctgtaatgccgtgggacagatggctacagattttgcacctggtttccaaaagaaatttcatgagaaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaattcatgcaggatgcatcagatgtgatgcagcttttgttaaagacccagacagacttcaatgatatggaagatgatgatcctcagatctcttacatgatctcagcatgggccagaatgtgcaaaatccttggaaaagaatttcagcaataccttccagtggttatggggcctttaatgaagacggcttcaattaagcccgaagtagcccttttagatacccaagacatggagaatatgagtgatgatgatggttgggaatttgtgaaccttggagatcagcaaagctttggtattaaaactgcaggactagaagaaaaatcaactgcttgccagatgttggtttgctatgctaaggagttaaaggaaggctttgtggagtacaccgaacaggttgtcaaactgatggtccctttactgaaattttatttccacgatggtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaagtgcattgaagtaatgggagatggatgccttaataatgaacactttgaagaactgggaggtatattgaaagcaaagcttgaagaacattttaaaaatcaagaattacgacaagttaaaagacaagatgaagactatgatgaacaggtcgaagagtcactacaagatgaggatgataatgatgtttatattctgaccaaagtgtcagatattttacactcaatattcagtagctacaaagaaaaggtgttaccatggtttgaacagctgcttccattaattgtcaacctcatttgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggc

SEQ ID NO: 1423 - DNA, 3395 bp, Homo sapiens
cttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatggcctatcagtttatcttcagctgtgcacagacagatagaagccatcaacagagactttcactcttgcctgggctggatgcagtggcgcggcctcagctcactgcaacctccacctcccagattcaaggattctcctgcctcagctttccgagtagctgggattacagattcacatatgctgagtttaccacatcttaggagcagacagcttctttatgatgagttggatgaagtaaacccacgtcttcgagaaccccaagagctcttttccattttgtctaccaagaggccactgcaggctccaagatggccaattgaatgtgaggtcatcaaggaaaacatccatcatattgagtgggctccacctcaaccagaatatttctatcagcctaaaggaaatgaaaaggtaccagagattgtaggagagaaaaaaggaacagttgtctatcaattagattcagtgcctatagaaggttcctattttaccagttccagagtgggaggcaaacgaggaattgtcaaggaacttgctgtcacgttgcaaggaccagaagataatactctactgtttgaatcaaggtttgagagtgggaatctgcaaaaagctgtcagagtagacacctatgagtatgaactcaccttgcgaactgacctctacactaacaaacacactcagtggttttattttcgtgttcagaacaccagaaaagatgctacctatcgcttcaccattgtcaacttgctaaaacccaagagtctttatactgtagggatgaagccactcttgtactcccaattggatgccaacacccgcaatattggctggaggagagaaggaaatgaaatcaagtactacaagaacaacacggatgatgggcagcagcccttctactgtctcacgtggaccattcagtttccatatgaccaggacacttgcttctttgcacacttctacccatatacatacactgatttgcaatgctacctcctgtcagtggcaaacaaccctatccagtctcagttctgcaagctccaaactttatgcaggagcctagcaggaaataccgtttacttgctcaccatcaccaacccatcccagacccctcaagaggcagctgcaaagaaagctgtggtcttgagtgccagagttcaccctggagaaagtaatggctcctgggttatgaaaggctttttggacttcatccttagcaactccccagatgcccagctcctcagagatatttttgtcttcaaggtgcttcccatgttaaatccagatggtgtgattgtggggaattatcggtgttccttggccggaagggatttgaacaggcattataaaaccattctgaaggagtctttcccttgtatttggtacaccaggaacatgatcaaaagacttcttgaagaaagagaggttctgttgtattgtgatttccatggccacagtcgtaagaataatatcttcctgtatggctgtaataacaacaatcgcaaatactggcttcatgaacgagtctttcctttaatgttatgcaaaaatgcaccagataagttctcttttcacagttgtaattttaaggtccaaaaatgcaaagaaggaacaggacgagttgttatgtggcggatgggaatcctaaacagctacaccatggagtctacctttggcgggtccaccctgggtaataaaagagacacccactttaccatcgaagatctgaagtccttaggttatcatgtctgtgacacccttctggacttttgtgatcctgaccaaatgaagttcactcagtgtctagcagagcttaaggagcttttacgacaggaaatccacaagaaattccatgaacttggacaagatgtagatttagaaggaagttggagtgacatctctttgtctgacattgaatccagaaacagcaccagtggctctgacagttctctctcagatggtcttcctgttcacctagcaaacatagcagatgagctgactcagaaaaagaagatgtttaagaagaaaaaaaagaagtcacttcagactaggaaacagcgaaatgagcagtatcagaaaaaaaatttgatgcagaagttaaagttaacagaagatacctcagaaaaggcaggatttgcttctactctgcaaaagcagccaacctttttcaaaaactcagagaattccagttttttaccaatgaaaaatgaaaacccaaggttaaatgagacaaatttaaatagaagagacaaagacacccccctggacccatcaatggccaccctgattctgcctaagaataaagggagaatgcagaataagaagccaggctttacagtatcatgctctccaaagagaaccataaactccagccaagagccagctccaggtatgaagccaaactggcctaggagcagatatcctgccacaaagagaggctgtgctgccatggcggcatacccatccttgcacatatacacatacccgtaggtgagcctgggctgtgccacacaagcacttcatcgggggttttgagattagacacattttataatgggggagatgtatgactgggaactgcatttacttgtggtatactgtgttgtgcactcatgcactgaccttacactttgtacttacactgtgggcatgtggtcaagatgcatacctcatgaattcaactattttttcataaaatgaaattttattatgatgtgtaaaaatgctttatcagaaactgaagtgtgttctcatggcacacttcatggcagcacagatatacctcattttaaccaatagatattctctctaaaattatgtgcaaatcaatttttaaaaatcaaaatctatgttaaacacattttggcagtgtgctataataaaaaaaagtgttgtgtcaaagctttctagtgacggtcagtcctactgctgtatgtcaggtttgctcacaatgaggtattcccacatagaaataacaatgcatgtattacccagaatttaatgttgcgtaccttatgttcaatgaggttttgtaatttttttaggctgatgattaaaattctttctctct

SEQ ID NO: 1424 - DNA, 6128 bp, Homo sapiens
agtctagtgggataccaggccctgagagacccctacgatcccaggacactgatgtggggtaactaacacccactggaagtctacgctgagttcacaggctatagtcagaggttccggttgagatcaagttgggagacacacccttgttcattctccttgagaagcagctattatcaacagaacattgacagaacctgtgtttggggaaaggactgatggctttgagtctaggttggaaagcacacaggaaccactgtggtctcctcttgcaggctctgcgaagcagtggtcttctcttgtttccctgtggccagtgtccctggagaggagctggaagctttttggaccctgagataaaggctttcctggaggagaacactgaagtcaccagcagtggtagcctcacccctgaaatccagttgcggcttttgacccccagatgcaaattctggtgggagagagctgacctgtggccccacagtgatccttactgggcaatctactggccaggaggccaagccctgtctaggtatcttttggataatcctgatgttgtcagaggaaaatctgtattagatcttgggagtggatgtggagctacagctattgctgctaagatgagtggggcatcaaggatcttggccaatgacatagaccctattgcaggaatggctattacactaaattgtgaattgaacagactgaatccttttcctattttaatccaaaacattttgaatttggaacaagataagtgggaccttgttgttcttggcgatatgttttatgatgaagaccttgcagatagtcttcatcagtggctgaagaagtgcttctggacctatagaactcgagtactgattggtgaccctgggcggccccagttcagtggacacagcattcagcatcacctgcacaaagtggtagaatattcacttttggagtctactaggcaggaaaacagtggactgacaacaagcacagtgtggggttttcagccttgagttgtcaaagtgcttccaagtatgaatatagtaatgtttggatctgactctaaaagttttctctataggagatactctccagtttaatgaatgtaattcttgttaaatggaaaatcttgtttttaaaatatgaaggtttagagttttgtttacttttgtcatgtaactggttctgtatttctatgcatgccaattatacacatctctatctgcatttttttttctattttaaccgctgaaggaatatgattatacaatgccatactcaatggtggcagcatttaatttaagtaatggagaagaattaaacattgtagctggatctgtttctgtagtcgaggacaactgtgatgtaactttgaattaaacaaacaaaacaaaacagaagaagactatatatatattttttctttttttagagacagtctcactttgctcccaggctggaatgcagtggctattcagaggcttaatcattgggcactgcagccttgaactctgggcttttttttttttttgagatggagtctcagctctgtcgtccaggctggagtgcagtgactcatgtctcggctcactgtagcctccacctcccccaatcaagcgattgtcctgtctcagcctccagagtagctgggattttaggtgtgcaccaccatgcctggctaatttttgtatttttagtagagacggggttttgccatgttggccaggccggtctcaaactcctgacctcaggtgatccacccgccttggcctcccaaagtgctaggattacaggtgtgagccaccacgccagcctgacgatgttttttacttctatcacttccttttgattttttcttatagcttctatctctgcttacgtcacccatcattcttgcgtgttgtatgcttttcgcattagagccctttgcatgttaatcagttattttaaatttatgatctggtaattctaaaatgtctgccataactgagtctggttctgatgcttgttttcttttcagactgtttttttgtcttttagcatgccttgtaattttttgttgatagctagacatgatgtattgcataaataaacaagtaaactaaggtagcatgaggttttaaaatctgggtagggctactgtttgctgtagagtagatattacaggctaaattttcctctagtgtcctggctattgtctcctctgttatctttgagtttccctagagattccttcttatatagagtctgaagcttgcagtttttttcacctgtaattccctgttattatacagtagcctaactgatgtgataaggtatgggagaaggtatgttctatagtcctgtgattaagtctcagtcagttaagtcagcctgtgcccctgctgtgaccttcacaagtgctttcagcttttcttttgtcactttggtgagacaggaaggctagaggcagctggagttgggtgcttcctttcccccaggtcaacgaggctctggtaaaatagtttcccttgagaactggcttttgttaaggagaactgaacacttgggcatatttcaaaatggttactttccctatcctcataccagaagaggggatttttctctgatcctcaccctgagaacctggtaggtatcctggaggtaaaactatgaaagtgtggtgtctcccctaggagtgggccccctggagtttgtttgttttaatttaacaaagtttaattgagcaaagaacaatctgtgaattgggcagctcccaaaagcagaataggttcagagtgactgcagggttgccacacctggttagataacgtttatggacagattcctagagcttttgattcttttttttttttttttgaggcagagtttcactcttattgcccaggctggagtgcaatggcgtgatcttggctcactgcaacctccacctcctgggttaaagtgattctcctgcctcagcctcctgagtagctgggattacaggtatacaccaccaaacccagctgggattacaggcatgcaccaccatgcccagctaatttttgtatttttagtaaagacagggcttcgccatgttggccaggctggtctcgaactcctgacctcaggtgatccacctgcctcagcctccccaagtgctgggattacacgtgtgagccactgtgccaggctggagcttttgattcttaagtccatccacatggagcctccagcaactcaggaattacagcataaatgttcctattggtactggctccagcaacaggcttctgctccctgtaagctatggttctttgtatttgcgtttctaatttgtgaggcattctctctttaaccttaattctctaatggatctaagtgttgttgacttttcagtttattgagcttttttcttattgtgaggatgggaatgatgacttccaatctctttatattagaaaatataaatcagactagagactggaaatttttgttgttgttgttgggtgttttgttttgtttgtttttagacaggtcttgctctctcatccaggctggagttcagcaatgcgaccgtgctcactgcagcctcgactttctaggctcaggtaatcctcccacttcagcctccttagtagctaggactgtaggcatgcaccaccatgatgcctggctagtttttttattttgtattttttgtagacatggagtcttgctacattggccaggctgggtattactgggtatttctttctttcctcctttatttctttccatatttacttattcaatgaatatttgagtgcttattatataccaggcactgttctaggcactggggatatggggatacagcaatgaaaaaaaaagataaatactttgtccttatgaaatttgtattctagagtagggagacataatgaacaaatgaaaacaggcatcagatggtgataggtagtaaggagaaaaagaagtaagggtaatagggaatactgggtactggatggggtacagatattttaaacagagtggtgagaaatagttaatacagctagcaacataaaaaaggagaaatatcaaactgcaaactgttttaggaagataaatccttcatagacccaaagaagctcacaatttagatgtcgaaactagtttctgcaaaaaggggaaaatgtgattgacttggttaaatattcagtattaaattttattgaatttgtctttagaaaaatttcatagttagaacaggccttacccattttgcacatatatacatatgcaccacctttgcagtggcaacatatatatccacactataaacataccacatttataaatcttgtaaggacaagaaatggagttgaataagtaccccccaacatatacaagaaagttagcatacttaccccgtttttcactacatcagaggcaaaataagaaatcttttaagaaaatctcaagactggctcatggcaaaatgaatatgctaaatttgggggttggtttaagcgtggtatgtgtcaggtaattttgtgattaccaaaaagttttcacttgaaaactaagacctttgctgtttatttcacaatgtgaaatcaataaacctgaggatacaagtctctgtagtgatattctgtatttactcatttttacacatttttgaatgcaattttgctaaggaaggaaagcttacagatgcataaaatgtaactgggaagagtagccataaaaatcaatgaatggatgtggctgggcaagagcctctgtaatactaatacgctgaatggctaataagtcacttcatttcggtgaaacaaatacctaaattctttgaagaattaacaggcttgatgttcaggtctgcttttggcaaatgggcatttaaatactccaagaaggtaagagccagaaaataggaaggtaactatgcttttagaaatatgtttacttagattctcccaaggtttatacttacaggtaaacttagaacaatagctcaaatacctacataggagaaggaaatctcaagggaaaacagttaattttaaagttatttaagaaacagaatccaacaccatagatcagagttcatgctaggattatcatttcaaaaataatgactcatccaacagatatagaataatagcactttaaagatgtttaagagtaaagcacaaaccatgtatataccaagacttagctaattctctgagagttataacttaagacaataaaataattaaaaatagtgttaacattaagtagaatgcaaatctctatagatggtttcctgggaaagtagttttgataagctttcctagcattgatcatcttcaaaaaagcatcaataaacagtccatgtcacttgctttagtttgtttgggcctactaattgctccaacacttctcgggaatgatctataaaagaaaacaatgacaatatattaattgacaataaaaaatgtttaatgtttcctcatgtctaactggaggtgatgttaattattatacagttatttaaaggattaaaggaggtgatctataaagcacaatatacaactaactcactaataattaattaatggtagccctcactattattaggtgtagtgcacctatcatggtattacttgtttaaaaaaaaaaaacaggcatttgttgttttctctgtaatttcatcataattccaccaaccagagtaatggtctaatttcaccattaacctgtgttaatggttaataacttttttcaggatcttagccggaaatagatgattcactaaagtggggtgactgaacagcatttaatgaagggaatatttaccaaaaaagtaggattaaagaaagccaataggtacggtaaaccaccttgggaagctgcaacacacccaaagggttaaaggaggtagtagtcaccgaacgtgacaagttgacctgtagctgaacatttttccatgtctgtataatactactataaagcatgattttaaatagataaccattatataaatacactgtaatttaaccaatctatattattggacatttagatgttttcagtttttcacaatgtacagtcgtgattttgatatggtttccatcctagttttaggatgtcttttaaaaatctgaattaaagcaaaaatactgataaaa

SEQ ID NO: 1425 - DNA, 5603 bp, Homo sapiens
aacgcagctgcggcggctgcgggtctcgtgggggcggagcggtcgccgctgccgccgcagctcgggtcgggatttgaaagattagaaacttcgggtggagagggcggcggcgttgaatgtgtggcggaagcgctgggggtcacggctccgcgcgccgccggacagccggcggcgtctccacagcatgaattacccgggccgcgggtccccacggagccccgagcataacggccgaggcggcggcggcggcgcctgggagctgggctcagacgcgaggccagcgttcggcggcggcgtctgctgcttcgagcacctgcccggcggggacccggacgacggcgacgtgcccctggccctgctgcgcggggaacccgggctgcatttggcgccgggcaccgacgaccacaaccaccacctcgcgctggacccctgcctcagtgacgagaactatgacttcagctccgccgagtcgggctcctcgctgcgctactacagcgagggtgagagcggcggcggcggcagctccttgtcgctgcacccgccgcagcagcctccgctggtcccgacgaactcggggggcggcggcgcgacaggagggtcccccggggaaaggaaacgtacccggcttggcggcccggcggcccggcaccgctatgaggtagtgacggagctgggcccggaggaggtacgctggttctacaaggaggacaagaagacctggaagcccttcatcggctacgactcgctccgcatcgagctcgccttccggaccctgctgcagaccacgggtgcccggccccagggcggggaccgggacggcgaccatgtgtgctcccccacgggcccagcctccagttccggagaagatgacgatgaggaccgcgcctgcggcttctgccagagtacgacggggcacgagccggagatggtggagcttgtgaacatcgagcctgtgtgcgtgcggggcggcctctacgaggtggatgtgacccaaggagagtgctacccggtgtactggaaccaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatgctgttcatagtttcaagttgagtcgaaaccatgtggactggcacagtgtggatgaagtatatctttatagtgatgcaacaacatctaaaattgcaagaacagttacccaaaaactgggattttctaaagcatcaagtagtggtaccagacttcatagaggttatgtagaagaagccacattagaagacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataactaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcattggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactctcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcatacaacactagttcaattttttaaataaactttttattatgttacatgtacttcagagaaagctaaagtttctctaaacttgacacggagtactccataatgggtacatttcattagctttattagaaaactagtaaatgcttttgaataggtagtatgacagctattttaaatgtataaacatttgtgtgccaaacaacatatatgaagggatgtgatgccactaactagtgcacattgtttctcaatgtgccattgagacacaaggcacagtaagtcaggattctgaggcattggaagggttttcttcagctgtaattgtttccacagtgcttttcatctgaggggctcaaagtttaagagtgcattcaataacccatgtactagcttcttgaggtaagtaaataaatcttgttctcatgttacatgttaatacaccaaggcaccaaaacatttaaagtgccatgaattagattacatcagaaatcagaaaagcttggattgagctagtcaccgtggttcacgcctgtaatcccaacacttcgggaggccaagatgggaggatctcttgagcccaggatttcaagaccagcttgggcaacatagtgagaccctcttctctgcaaaaactgacaaaaattagccacttgtagtggtgtacacctgtagtcccagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccaggccatattcttttatatgctgttcaatgacttgattcacatgtgaccttttagtagtttgcaaacaataataacagaagttgcaattcataattcagagaaatgaccatgaagccggtgtttccctgcttgatttctatgttcttggattctcacacaaaagaggagttacctagaggggatcagtagccatccctgttgcacacaaccctcacttctgagtggtttccactaggttccacttaaggtgctgtcttttcttaacttgcaaggaattgcttagcttcccaataatcattgtcaaactgggagcaaagttggtcagctgtatctctcacctcctcctttcttcataagatagtagaatctgtggcttacttgtaggttttacttagtgcttcagtactgttggctgttttggccttttgctgaatttgcacaacaacataaagcacttctttttaatgtttaaaaaaaattccaaggctccatgaccaagtatgtgactcactaagaaacccttgctataaaaggcttttgatgaaatcttagcaaagctaaattatctctaacttagagattcctatgaactcaggtcattttcatagcctgtttattttgtaggtctaatttagttctcaggaaaattaaactcatgctatatgactgtatcgttaaaggtacttgagcgtatgttgctgtaggtggtatgacactcaaatgcataagaacttgaagggatttattcttaaccactagaatatgaagagccctttttacctgagaagagtgaaattatgtcagaccttttaatttgatatcactgagtaaaaggtatgttcctatagccataggaatatgtctgcttcctttttttcatgttgagaaaacagtcaaatttaaccatttggagtttatttgaattcttggaaagagcaatattcaaaaccttttcaaaaataagatattctggactactggatggatgttttgttttcagttcatttttcatcagtagagatggtgatttcggttttgtagtatccttgtttctatgtctgtgcatgttaacattggatgtatttgtatatacttaattaatatacagactgtgtgtcattctggcttgattagaagctaagtcagttactgagtaacattttgcaactttattccagcaagtactaaatcggccaaaaaaagttttgtttttgataccattaaaattttattctct

SEQ ID NO: 1426 - DNA, 1883 bp, Homo sapiens
aagatggttgattcacagaacccaggctggacgggacttgtggcgagcagtccagcacagcctcacagtgcagagcatgagctttggagcctgcccccaccctagctttgtgaccttaagtgagctacatagcttctcatgtgtaaactactcatcataatggttctgacctcagtggtttgttgtgttctaggaaatgatgccagtgaatgcgtagtcccagcctcagcacaggggagccaccttgaagctctcaaatatcactgttgtgaatacagagagggaaaaccaactgtaacgtgccacccaaataaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatccccaaggccccagaagaaaccatccaatccaagaaggaggacctccccaagtcctcagaaaaagccatccagcccaaagagagtaacatccccaagtcctcagcaaaacccatccagcccaagctgggcaatattcccaaggcctcagtgaagcccagccagcccaaggagggtgacatccccaaggccccagaagaaaccatccaatccaagaaggaggacctccccaagtcctcagaagaagccatccagcccaaagagggtgacatccccaagtcctcagcaaaacccatccagcccaagctgggcaatattgccaagacctcagtgaagcccagccagcccaaggagagtgatatccccaagtccccagaagaaaccatccagcccaaggagggtgacatccccaagtcctcagcaaagcccatccagcccaagctgggcaatattcccaaggcctcagtgaagcccagccagcccaaggagggtgacatctccaagtccccagaagaagccatccagcccaaggagggtgacctccccaagtccctagaggaagccatccagcccaaggagggtgacatccccaagtccccagaagaagccatccagcccaaggagggtgacatccccaagtccctagaggaagccatccagcctaaggagggtgacatccccaagtccccagaagaaaccatccagcccaagaagggtgacatccccaagtccccagaagaagccatccagcccaaggagggtgacattcccaagtctccaaaacaagccatccagcccaaggagggtgacattcccaagtccctagaggaagccatcccacccaaggagattgacatccccaagtccccagaagaaaccatccagcccaaggaggatgacagccccaagtccctagaagaagccaccccatccaaggagggtgacatcctaaagcctgaagaagaaacaatggagttcccggagggggacaaggtgaaagtgatcctgagcaaggaggactttgaggcatcactgaaggaggccggggagaggctggtggctgtggacttctcggccacgtggtgtgggccctgcaggaccatcagaccattcttccatgccctgtctgtgaagcatgaggatgtggtgttcctggaggtggacgctgacaactgtgaggaggtggtgagagagtgcgccatcatgtgtgtcccaacctttcagttttataaaaaagaagaaaaggtggatgaactttgcggcgcccttaaggaaaaacttgaagcagtcattgcagaattaaagtaaacatgtattctgaaaaca

SEQ ID NO: 1427 - DNA, 1480 bp, Homo sapiens
ctcccataccctataactttgtttgttctatttcacacatataattttccgagacaagatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaa

SEQ ID NO: 1428 - DNA, 2609 bp, Homo sapiens
ccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaa

SEQ ID NO: 1429 - DNA, 1370 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactgggggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagtt

SEQ ID NO: 1430 - DNA, 1439 bp, Homo sapiens
ccctctctggaacactgtctccactgagttttaggtaagtgtgtgacagacaaacgagcagaagcttggagaagctcagggtggatcttggtggccggagctactgtctcggcgcatgagcttggaagcttcaggaagcagggctggggaagcaccctccaggctgcagttccagggaaggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcggggactcaagggcaaaaaactgtatcctgtagtgagtgccgtctggggccactgtgagatccgaatgcgctacttgaacggactcgatcccgagccgctgccgctcatggatttgtgccgtcgctcggtgcgcctggccctggggagggagcgcctgggggagatccacacgctgccgctgccggcttccctcaaggcctacctcctctaccagtgacgttcgccatcataccgccagcgcgacagccacctggtgccaactcactgagccgcctgccgctggggccgccgcaccctgcaccttggaccggcatccgtagccatggacagaggtccctggtcttccctcatcctccgtggctgcctccatgggacaaggaccgattccaacacaggctcctctttcccccttcccgacatcagcagaaggcagcatccctgcatgccgtccgtatacaacccctctttgaaaaaagacacagagaataaactcctacgaaagccc

SEQ ID NO: 1431 - DNA, 4295 bp, Homo sapiens
aggccgccgcctgggtcgctcaacttccgggtcaaaggtgcctgagccggcgggtcccctgtgtccgccgcggctgtcgtcccccgctcccgccacttccggggtcgcagtcccgggcatggagccgcgaccgtgaggcgccgctggacccgggacgacctgcccagtccggccgccgccccacgtcccggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgagattcccaagaaggtccggaaagaggctctgctgctcctgtcctggaagcagatgctggatcatttccaggccacgccccaccatggggtctactctcgggaggaggagctgctgagggagcggaaacgcctgggggtcttcggcatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacaggcagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccaacttgatgtttgtgttttgtttggggggatatttttcataattatttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaacatgt

SEQ ID NO: 1432 - DNA, 7643 bp, Homo sapiens
gcgggtcgttagctgtcagagccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcagggactttctccctcgagggtcgggcattgtaacaagacgacctcttgtgctgcagcttgttacttctaaagcagaatatgccgagtttctacattgcaaaggaaagaaatttacagattttgatgaagttcgccttgagattgaagcagaaacagatcgcgtgactggaatgaataaaggcatttcctccatacccattaatttacgagtctattccccacacgtgttaaatctaacccttattgatctacctggaataactaaagtgcctgtgggagatcagccaccagatatcgagtatcagatcagagaaatgattatgcagttcatcacgagggagaactgtctgattttagctgttactccagccaacactgatcttgcaaactcagatgcgctgaagctagctaaagaagttgatcctcaaggtctgagaaccattggagttatcaccaaactggaccttatggatgaaggaacggatgccagggatgttctagagaacaaactgttgcctcttcgcaggggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagatggttcagcaatttgctgtggactttgagaagagaattgaagggtcaggggatcaagtagataccctggaactctcaggtggtgctaaaatcaatcgtatttttcatgaacgctttccttttgagatagtaaagatggagttcaatgagaaagaattgcgaagagaaataagctatgcaatcaaaaacatacatggtatcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaactggcaaacttccccagactctgcgaggaaacggaaaggattgttgctaaccacattcgtgagcgagaagggaagacaaaggaccaggtattgctattgattgacattcaagtctcttacatcaacaccaaccatgaagacttcattggcttcgcaaatgctcagcagaggagcagtcaggttcacaagaaaaccacagttggaaatcaggtgattcgcaaggggtggctcaccatcagcaacattggcatcatgaaaggcggctcgaagggatactggttcgtccttactgcggaaagcttgtcctggtataaagatgatgaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtagggaacaacaaagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacagccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaagccggagaccacccccatcaccaactcgtcccactataatccgcccactagaatcctccctgttagactaaacgaagtgtctggcatggcaattaatcactaatgaattatgcgaaagcaacatatttgataaccgttgcagtaaatcatgagtagtcgcatgtgtggacatcagtaggcaagtaaccagttttactaatgcattcatcgctcatcttcattgctcatggtatgtcaaacctttggggtttgactcagaaactgctaaccttttagaggctttatatgttgtactgaccaaggtaggtttgtatagcagccctatactttggggatcatttgcctaccatggcatatatttgaaattgctttggacaagttttctaggctatctaccaggtagctcattaaacgtaattcttcagatatgagatagtgggcttagacctaagccatacatatttcttttcccacattctgtttaggatgacagtaattctgttgtctaccattaatgctactacctactccataattgcctatttagctcctcttttcttcctttttatttcataagactgctaggaagtgattttttaaaattaggactccttaagaataaacttttccagaagcacgaggtagtttgcaaaggaaaagtctgcactgtttgctctaaagagcttctcctcattccaatgtgttttgcttcatgctagaagcatatgcaacagtgaataaaagcttctttttttgttaatcagtcaataaatttggctaattagtttcagagttcaaggaagaagcaaaatatcacatctctagaagtgttgggaaaaatataatttctttctttacttatattcacctcatggtaggttatattgaaggctgacatggagaatgtttacttttctatttggcatagctaactacactttgatactaactccagttttactattattattttggttggaaaaaaaattcactctttacgtgctaatttgtaatcttgttttgtaagaatttatcctacccttgaaacaggctcagtgtaactgtatatccattctaggctttcttaataaatcttgaggctatgggataatcacatttaaagaatggttcctgaaatgaagtcagtagaaatggcatgggataagagcagagctcacacttttacagttgcagtatttcaaagtccctatccaggtcactccagaaaagggtattgaaacgttgaaatctaaagcaaatttgcaatttcttaagatttctaaaatttaccagaacagtttagcctgggggttaatagttaagtcttgaggctaagttttggactaccaaggaccagatgattcacatgtaggaaacagccagaagccaactggaattttgtgtgctaactgttcccagacagcagagcaagtattcactgagtaggggtgtcccatgacactatttcatattctacagaagtaaatcaggtttcaccaactgaaatgtctccctttgaaagtagcaaacatgatttgtatgttaacttaactttaatttcctgtgtagtttacacccagagcagatactcataaagtataaagtaaaaacttttaaccattattaaacagagaacttgccatgttgagtgccattgtattgaacttattctaaaggcttatgctaacccatttataattggtaaaaatcagaaaatacaagatttacataaaggtcatttcaacttttaaggttaccagtgattgtataaaaacatcacaatcctaaatcctctcgtatctcaccccaaaccccaaactgggggaaaaaaagttaactctttgtgaatggaaccaatgtgcaagatacatactgcatttttaaaatagtgtctcagctaaatggaaaactgttaagcaaacatccatagtaaaacaaataatcttcagtgagatctttttataaaacttcttgtttttaggattccctttgcttcttcctttgaattctctaaaataggcagctaacggattatatacttcagggtttggctttgtgctaaatgtggttttgtgttttgctgtatttcaaaattttccttctgttaaaggaaaatattgtgaataaccactggtgtgttcttagatcagcacaaaccatgtcaaaaaaaattggagatttttttccaattttccttccactgatcttaggcagtaataaacaatggcatttgtcatctttggcacttgcttttagattatagtcccacagttgcactgccccaattgtctacctttgtgggtacatttttgttctttactcctaagttatttctcatagaacccagcctactctagaatttcagcagtgacattggagaatatttttaatttgctgcagtactatgtcatattattagtatgaatctcatttcccaaagggtttgtattctgctaaaaggagatgccaatgttgaatgaagtctgaaactctagtatgtgcatagtttgacgtgcagcatgcacaccaggccttaagatgggaatgtagcttaatgattttctgtttcccataccatttctaatcttttgtgtaattttctcttaactgattgctctgatattgtaaacacaatagatgtagctctatcatgtctagcataatttaaaaaatcagtgtttttaggatttgggaaaataaactgtaaatgtttatttgataggtaaatatagttttattgtcacatgctaaatattgcatgcatattgactaattggaataaccatttactcaattatggacagcttattgaaatagtattgatttagaaaaagtatattgcatttctaaaaaacatctaccaaggttactcgtctgaatattgcttttagccgtgttttataacatagacgagcagtagggtctgtttattagcaaatttcctatttgttccaatacaaactcactttattctaaagtatattaatgaaaccagttcctgtgatgtaactgtaagccttctcgacttagacttaaaaagtggtcacatagattaattttgtgactttttagtatagactgtagccataattctcaaatatgaaatgggacctaataccagtatgtgataaatgttgatgttttctgtgtacaaacacattttctatgcatgtgtctctgtgtatatggcatatacctagtaagtatgtttctgtaagtatgtgtattttatgtccatttgagtaggtaggtaggttttaaaaatactagttaaaatgccacaagcatgagtgtgattgtatgtgcactgtgtgtatatatataaatatatgtatatgtatggttgtaaatatctatgtatacatgtacttagtatgtgtggtatcaggatattttttaaactgtgataatacaacagatagctttgaatgatctgccataacatgtggtaacaatagttcatttctcataacatatatgaggtatacaaaattttctaactccagattgtagtcattttgagaggtacaaagctcataattaccatgacaacatggtaatgtccatagacatttgtatctgaatccacaagaagatctgaatctaagaaggaattacctttgacaatatttttcggtaagaagtaaaacctctggagacctatctttaagatctctaattggaattataaattatttttggattgctgagctgaatcttaaaaagccaagttgatatacatagtcatttttcctctatggtagaagtaaaaaaaaaaaaaaaggacatagcaacattaaagtagtggatttttctgagtaaatttgctgaaaatataagagagaagctatctaataccttggaggtaggtcatccactttttcaggtaaacatttttcatttggcaaatggcataattatttgaaagtgacaggaatctcctcagaatgaagaataaagcctactaggtctctaactgttgaactcatgaaagaagatagtgtatgagacttaagccatgagttttgtatcatttcaattagaagactactagctgtgagctcagagtttaatgtaaatgaatctagatgattttgaagaaatgattattcgttcaccagatcactcattgtacattctaaaaagctcaaatgagtcttctagatactcttactcatcctgtctggttgctatgtttaaaattatgtggtgctgtgtaggtgaaactttaagaatatttttgaagcatatgtaatatatgcactgctatttgtgtgtgtgtgtgtgtctttgtatatatgtaagaatgtgtgtatgtgtgagagcaagagagaggaaactcaaagaggagtgtttgtcttaagacctgttcatactggtatattggtgagacttctcacttctggttggaggtttcacatatggctcaactcaagtcattaatctctttttaatttttactcttgaattccttaaacttcgctcattatgaaatgttttaaaattatgacaaaaattactctgtctaaccacttgccttgtctgctaccagtttgttaaaaattattccccccaaccagtaattccaccagtactacttgatttgtgttatatttcctatgtacatgtacagcctttgttttgcttgcttgtctatttttactttcccttttttgggtcaaatttttcttttgctttgtttgaagaaggaatatacagaagtaaaatcttgtcttctctgctgattctttaattaatatgagccggatactttccactgtcttcttggcactttcaggatttcttaatgctgatatatggactcttagaatggaatttttgaagaaaaatctcaaagcctgtatcgttcttgaaggtcacatgtacctattgtgaaaatgtgaagctgtatttctgaagctgaaataaattataacatttgaagg

SEQ ID NO: 1433 - DNA, 1822 bp, Homo sapiens
agtagcgggcggcagagctggagtgaagggagctagtggtaaagggagctggtggaggggtggcggcaggggtaaggggcaggggacaccctctagacggagagcgggctccgaggtcctggctggccctcggtgcgcccgcccctgtgttggtcccacaatccctggcaatgagaggccagggtttattggacagagtcagttgtggggttcagagggtcagcaatcaatcaatcctccgaatccagagatttagacccagtcgtccgtattaggactggaggggggtcaataggttcagtgtttgagatgccaagggaacctgtcttttgatttggggttcaacatacagaggtagcagtcaccattatgctcaaagcggtgatcctgattggaggccctcaaaagggaactcgcttcagacctttgtcttttgaggtgcccaaaccattgtttcctgtggcaggggtccctatgatccaacaccatattgaagcctgtgcccaggtccctggaatgcaggagattctgctcattggcttctaccaacctgatgagcccctcacccagttcctagaagccgcccagcaggagtttaaccttccagtcaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggctaacaggacgcaatccctcaactacggctgcatcgttgagaatccacagacacacgaggtattgcactatgtggagaaacccagcacatttatcagtgacatcatcaactgcggcatctacctcttttctcctgaagccttgaagcctcttcgggatgtcttccagcgtaatcagcaggatgggcaattggaggactcaccaggcttgtggccaggggcaggtaccatccgcctagagcaggatgtgttttcagccctggcagggcagggccagatatacgtgcatctcactgatggtatctggagtcagatcaagtccgcaggttcagccctctacgcctcccgcctctacctgagccgataccaggacactcacccagaacggctggccaagcacaccccagggggcccatggatccgagggaatgtgtacatccacccgaccgccaaggtggccccctcggctgtgctgggccccaacgtctccatcgggaagggggtgaccgtgggtgagggtgtgcggctccgggagagcatcgtcctccatggagccactttgcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttgg

SEQ ID NO: 1434 - DNA, 5849 bp, Homo sapiens
agtagttccgctccgagggcggaagtgcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttttttttttttttgagatggagtcttgctttgtcacaacctccacctcccaggttcaagcgattctctttcttcagcctcctgagtagctgggactagaggcacaccaccaattccggctaatttttgtatttttagtagagactgggtttcaccgttggccaggcgggtctcaaactcctcgtctcaggtgatctgcttgcctcggcctcccaaagtgctgggattacaggcgtgagccactgcgcccagcctgagtttcattttttaagtcacatagcagtagtccttatttcagtgctagaccctttgaaatgcgatgaaagctatatggacccttcgctttgttatataacatatgcacacatacccagaattttgcacatatgttcagagattcctagacctgcagacctgcctctgtgtgtcccaatttaagaacctctgttctttcttcatgactggatttgcccaattttgtgttattttgggacttaatttgtccctctttgggacatttccttatttattgccctcttcagagagtagatgtagaaaataaagagaggaaacctagattacttaattttattttaacattttctatagatagcataccacgccaagtgtgctctgtcttgatccccttctttctagcatctgccagacattgtagagtttcgcaagcagttgtaggtttgagctgcagccagtcatttcttttattctttaaaagtacatagatttgtctttttagggctttactgaaagtaaaatatcctgacatttaaactgacagatgtaggaggtaaaaaatagagttctgaaacatttgaatttatgtgacagctgaagtcacgagatgagggatatatgtcccccagggaggatgcagaaagaagaaaagggtactggaaacagcatgtcagtggtgccagctgagggctggaggcagccaggagagttgggagcctgggtgctgggtggagagaggttaacagggaagacatgggaagtattgtgaaggctggtgtgagcaggggactactccagccctgttggaacatagagccatttggcagattgacaatgcagtgacagctgtatataataaatgtgttgaaaggaggaaggtgaggattttcttggtgggagtttatgctgttatttaacatattttgcttccaaaggggttaagatgttttacctaaatggaggtttctaggtcagtgctatacaatatttctaatctgtgttttatagtgtgagctacatatgtaattttaaaattttcaagtagccacataataaaggaaacaggtgaaatttaatgacatatttcctttaatacggtatatccaaaatattattatgtcaacctataatcagtataaaaacctgttactgaaatattttatagggcccatctcagttcagactagccacatttaagtgcttcatagccacatgtggctcatggccatccatatttggacaatgtactttagactattgcatctgtatactcttgtgccgtcagctggggggtggggtgtgtgtgcgtgtataccaaggcagtgagcatctgagctttgaacctcaaagaccaaaatgccctgcccattttcctgcttatcagctgaggaatctttacccacattgacacatgggcttgttctgacccaagtgcatgcaggcttccagagcagattcagaggcctaacttagtcctttagctttcctcccagcacagaactcccaaggttatctgcaagtaggccttgcctagagagactgagttttcaagttgtcagttttcccaaattgtcctcaagcatcttcctctggaatcaccttactgtttagtaaacattcagaggacttgctacacatctgggcagtctgcattgtaattcatatgtgtttacacatttgtgtcttcatctgctaaagcacctttgaaccatattgtaattcataatatctgaagcaattattatgaattgtagtaattcataatattgaagcgattcataatatctgaagcaatccccagatacgggttaggcatggccctgctctgagcaggatggcaaaagtggcagtccgtgacgcagcccttgttaccccaggctattactaaatggtggtggtggttttatcttaattaaaatgacatcaccaacaatgggccctttcctgtctgccaggaaaagttttctgtagtgacgcacgtgttgtgtgtgtatgtgtgcgtttgaggctatattactcattgctacggcagttcaaaatgacttggaaaaaaacaatgaacgctggtcattgatatgtatactgacatgtttgagggaagttactgtggtctgtaacttatgaaatacataaaaaatatgatgggtggagtgacggacacatggacagatatgaagcaagcactgtaaaatattagtggtagtttttgtatgcccatactcacggcaccattattcacagtagctaagagatggaagcaatatgtgcccatcagtgggtgaatgatcaacaaaatgtggtatattcatacagtggaatattattcagcctctaaaaggaagatacgctgacatgtgctgcaacatggatgaatcttgaggacatgatgctaagtgaagtaagccagtcactggaagacaaatactctatgcttccatttatgtgaagtatctagagcagtcaaatgcatagaaacaagtagaatggtagttgccaaggactgggggaggaggaaatgaggagttgtttaatgggtatagtgtttcagttttgcaagataaaaagtcctgtggattggttgcacagttaagttatgtgaatgctgtatgccaactcaactgtacactctaaaatggttaagatggtaaatcttatctttattttaccacagttttttttaaagcatggtaaacaccatttcccaggatgtaaatcggtactaaaaaaaaagtgctccaaagtaagatatatttgggaaacacagggataactaaggttagataggtgttctttattgcaggaattctaagagcatttaacaaattaatttacactgggaattttcagtgtggagggtctggctcatagcatttcacaaacattatacttcagagtcccaaagcctttaaataaaatgttaatggtagaaactccttaaggggtgttcactgta

SEQ ID NO: 1435 - DNA, 4080 bp, Homo sapiens
aaacggggtcacagcaggacaaggaagtagccgatctcccagatgcggtctcttcgctccgctccacccgcaccagcagcggcccacccacctctcctgtaagaggaagaacgtcccggagacacttccggccccgccccccgaggcggaagcggagtgccaggctactcctcccgcagtgtgggtggttccgaggctgactaccctgcggcggcgcggctcgcagtccttctcagcatggaccgcacttgtgaggagaggcccgctgaggatgggagcgacgaggaggacccagactccatggaagccccaacccggatccgggacactccggaagacatcgtgctggaagctccggctagtgggctggcgttccatccggcccgtgacctactggctgcaggggacgtggacggggacgtgttcgtcttttcctactcttgccaagagggagaaaccaaggagctctggtcatcaggtcaccatctcaaggcctgccgagctgtggccttctctgaagatgggcagaagctcattactgtctccaaggacaaagccatccatgttctagatgtggagcagggccaactggaaagacgtgtttccaaggctcatggtgcccccatcaatagtcttctgctggtggatgagaatgttctggccactggggatgacacaggtggtatctgtctctgggaccagcggaaggagggccccttaatggatatgaggcaacatgaagagtacatcgcagacatggctctggatccagccaaaaagctgctgctgacagccagcggggatggctgccttggcatcttcaacattaagaggcgtcggtttgagctgctctcagaacctcagtctggggacctgacctctgtcactctcatgaaatgggggaagaaggtagcctgtggctccagtgaaggtaccatctacctcttcaattggaatggctttggggccacaagtgaccgctttgccctgagagctgaatctatcgactgcatggttccagtcaccgagagtctgctgtgtactggctccactgatggagtcatcagggctgtgaacatcctaccgaaccgagtggtgggcagtgtgggccagcacactggggagcctgtggaggagctggccctctcccactgtggccgcttcctggccagtagtggccatgaccagcgcctcaagttttgggacatggcccagctgcgagctgtggtggtggatgactaccgtcggcgcaaaaaaaagggaggaccactgcgggctctgagcagcaagacttggagcaccgatgacttcttcgcaggactgagggaagagggagaagactccatggctcaggaagaaaaggaggagactggggatgacagtgactgaaggaatgaattgaatcttgagacgggtcctcaccaggcaagagtcttgcttattgggctgcatccccagagaggatatgaattattttttgaaaagacagggttttgccatcgtccaggctggagtgcgctggcttgatcttggctcactgcagcctcaatgtccccaggctcagattgtccttccaccttagcctctggagcagctgggactacaggtgtgcactaccacaccaggccaatttttgttttttttttttggtagaaacgggtctgttttgcccaggctggtcttcaactcctggactcaaatgatccacctgcctctgcttcccaaagtgctgggattacaggcacgagccaccacacctggccaaaaaaatttatattttttgagacaaggtctcactctgtcacccaggctggagtacagtgggttgatcatggctcactgcatccttgacttcctgggctcaagtgatccacctcagcctgcctggtagctgagacttaacaggcatctgccaccatgcttgactaatttttgtgatttttttttggtagagaccaggggtttcactatgttgaccaagctggtcttggaactcctgggctcaagtgatcctcctgccttggcctcccaaaatgctgggattacaggcatgagccactgtgcctggctggatatgaaattttttttttttttttttttgagacagggtttcgctcttgttgccagggctggagtgcaatggcgtgatcttggctcactgcaacctccgcctcccgggttcaagcaattctcctgcctcagcctcccaagtagctgggattacaggtgtctgccaccatgccaggctaatttttgtattttcagtagagacggggtttctccatgctggccaggctggtctcgaactcctgacctcaggtgatccacccgcctcagcctcccaaagtgctgggattacaggcaaaagccaacacacccggcctggatatgaatttataataccctacagtgcaacacaagaagatgcactcaaagcactgatgtgaggaagtacttgccccgtagcagctattcactctaccagtgtaaacaaactctaagctagggcaagacagcacagacacaagtatatactaaccaggggtttaatataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggacaaggaacggccatggaagatcactgggtcaggttggaccctgggctgggagcgggagggcaaggcccctcaccacaacttaacccaaacctaagctgcccccaggtgccataggtccctgtcccagcagggaggctgatgggcctgggcccatgcccctccccacctttgggggtcagaaagtggccacccaggcctgctgggatggggcctgacacaggctctgcatgcccattcagggtgcctgtggagaaagaatggagtcactgtttaaccatggtacctgcctcagccccagcagaccacaggaggttggccccagactcactgagtgcctgcagcagccgtacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttggaaccctaacttgtcccttgccaaagccaactggctgccctctggctgtggggaccgcaagaagggacccacaagctgctggcgaagtcgctgcttcaggtctggcttgagccactccacagccacctgctctccacagaggtgtgactgccctgtaggaaaaatgcaaagacaagggcaggtctaaaccctgggcccaagcctccaggtggtgagccctttggagctacacagtcctgttatttgtagccttcccatttcctggtagtgtgaccatgggtaagaaaagacaatgaagccttcagcctccattatttgcaaagggagtataacacactgctaccttacaagtttccttggagaagtactggttaattgcaggctttgtctgcctcataaccatcataatggctaatctttactgggaaaacttgctgtaagtcagtcagtgtgctaagtaccgtacacccattatgttacttaattctcataacagtctgaggaaacagattctatagtagtaaaaagctcagttggattcccttgagcaaatcaatttctctaacagtttcctcatagcttgagggtcctgtgcctattttgcggtgtgggggtgggggaaggttgagaattaagtcaggaggtaatgctcgggaagtgtcacaaatttaggtaagcggtggtggtagcaccattggaagttttaaaaatctgagatcaaatagtaaaaggttgcaaattctggca

SEQ ID NO: 1436 - DNA, 1796 bp, Homo sapiens
aaagggcgccacgagtcggcattgtcaggcggcggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 1437 - DNA, 4371 bp, Homo sapiens
ggcggcgcagttgcgagtgcaggtgagttccgggccgccaccggctgcttctgtgggccgggcctctgagcattggcgaccccagcccggctccgggctgacagggcctggcttcgccaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatcctttgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggacgatgacctgaaacctcgaggcctcacgggcatgaagaacctcgggaactcctgctacatgaacgctgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagccatctctgagaaggagcggatgaaggaccgcaagttctcctggggccagcagcgtacaaactcggagcaagtggacgaggacgctgatgtggacactgccatggctgcccttgacgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagccttgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtcctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccacctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgtt

SEQ ID NO: 1438 - DNA, 2983 bp, Homo sapiens
agtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagt

SEQ ID NO: 1439 - DNA, 1044 bp, Homo sapiens
aagctgggcagcctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagacatcaccgagccgcagagcatcctggcggctgcagagaaggctggtatgtctgcagaacaagcccagggacttctggaaaagatcgcaacgccaaaggtgaagaaccagctcaaggagaccactgaggcagcctgcagatacggagcctttgggctgcccatcaccgtggcccatgtggatggccaaacccacatgttatttggctctgaccggatggagctgctggcgcacctgctgggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaacatttctgtgtctgta

SEQ ID NO: 1440 - DNA, 4753 bp, Homo sapiens
cagactgctgcctccatcagtgcctgtggcgtgtgtgtgtgtgtgtgtgtgtgcgcgcgcgtgcgtgcacgtgtgtatgtgtgtgtgtgtgtattgggtttctctctcccttgtaagaacacagccagcccgccctctcctgctgttgctgcagctctgacttgctttttcctgcctccttcctctcctctctcttcttgcttagcttcttgccttctgatactactcccaagatggaggctaatcactctgaacagctctcagcggaacgacagtcaacacctccaggtgacagttcatcattacccagtcacaatggcctggagaaggaagatggccaggattctccaaccccagtccaaccaccagagaaagaggcaagtgtgcaccccgatatctctgaagagctgaatcgacagctggaagacatcattaacacttatgggtctgctgccagcacagcagggaaagagggctctgccagggccagtgagcagcctgagaatgcagaatcacctgacaacgaggatggggactgtgaggaaacaactgaagaggctggaagagaacccgttgcttctggagagccacccactgtcaaagagcccgtcagcaataaggagcaaaaattggaaaagaaaatcctaaaaggattaggcaaagaagccaacctgctaatgcaaaatctgaacaagttgcaaacaccggaagaaaagtttgattttttattcaagaagtatgctgaattgctggatgaacatcgtactgagcaaaagaagttaaagctcctccaaaagaaacaggtacaaattcaaaaagaaaaggaccagttacaaggtgaacacagcagagctatcctcgctcgaagcaaattggagagtctgtgccgggagctgcagagacacaacaagactctgaaggaagaggcgcttcagcgggcacgtgaggaagaagagaaaaggaaggaaatcacaagccatttccagagtaccctcacggacatccagggccagatcgagcagcagagtgagcgaaatatgaagctctgtcaggagaacacagagcttgcagaaaagctgaaaagcatcatcgatcagtatgagctcagagaggagcatctggacaaaatatttaaacacagagaactgcagcagaagctggtggatgcaaagcttgagcaggcccaagaaatgatgaaggaagcggaggagcgacacaaacgagaaaaggaatatttgctgaaccaggcagcagagtggaaacttcaggcgaaagtgctgaaggagcaagagacagtcctgcaggctcagctcactctctactcaggaaggtttgaagaattccagagcacactaactaaaagcaacgaggtgtttgccacgttcaaacaggaaatggacaaaacaactaagaaaatgaagaagctggaaaaggacacagccacatggaaagcccgatttgagaactgtaacaaagctctgttggacatgattgaagagaaagcactgagagctaaagaatatgagtgctttgtgatgaaaatcgggaggctagagaacctctgccgtgctttacaagaagagagaaacgaactccacaaaaaaatcagagacgcagaaatatctgaaaaggatgaccaaagtcagcacaactccgatgaagagccagagtcaaacgtctctgtggatcaagagattgacgcagaggaggttaatagtgtccaaaccgccgtgaaaaatctggccacagccttcatgataattcatcatccagagtcaaccccgcaccagtccaaagaaacccaacccgaaataggcagttctcaggagagtgctgacgccgctctcaaggagccagagcaaccccctctgatcccttcacgggattcagagagtcccctgcctcccctaactcctcaggctgaagccgaaggaggcagtgatgctgaacctccctccaaggccagtaattctcctgccgggttgggagcagaaacccaatgcgagggtctccctgttggagcacaggctgatcaggcgtcctggaagccagaggcagaagcttccggtcaggccccacaggctcccaccgaggcctccctacagaagatggaggcagatgtgcctgctccagcatgcgcagcagaagagcacgttgcagccatggtgcctgcatgcgagcccagtaggcagcccccacgagcagcagcagaggagctgccagtaggggcctcagctgggccccagccgcgcaacgtggctgacaccaatctggaaggcgtcgactaagcctcaccgtgccttcagaggcttcttcctgcctctttgcatattcagcataacagcttgtcttccgaaaaaggcattaagggctagagatgtcaaatggaagagacttaggatcaagacattttttaatgttaggcagaacacattcattcagactttgctatttgttgtcaatttatagctgatttgaaggttttctatttaacactggttgacagtataattttcccaaagggcaacaaaacatacagatagcaaatttatattccttttctgttaagataatacttaaatttgttaatcaccagtaagatttgatgtttaaagacttccactgcaatatataaatactgaaaatgtgatgttctgcttatttggatatatagtttaacaagttccatagtaatttatggatgcccaggttacatttaaactatacatatacataatatatacatacgtgtgtacttattatatgtatatatacacgtatgtatagatgtgtgaatatttgtttatatacatatatgcacgtatctatatgtatatataaatgcattattacacatacatttctctcaccccttaatgcatttttctcaatgcagaatatttagatgctaatcaaaaaaatgatctcttacttgcacttgagactatggttgactaatgctctataaatccgaagagagttcggactataagtatttaggctatcattatgttgggcaaaaataagtaacccaatggtagataaatgaattcaaccagttgatcaaatggcagaaaagcagttagactacaatctgtgcagacagcatggacacaaagatgaccacaaggggcccaaaacagaaaagagaaacacaagctcacctcttggagctgcttctcctacacttctcagcccattgctttgccaccccctcatgtgccagggcatcccattccaggcttcctgcaaggaaacggttggaagtgggaaaggggagctagggattgaggggttaagggacctcacactaagaaggggctgtgctttgatcccctgcctcttgcactaccaatgtctcaagacataatattcatctcttgctgtcagacccattctatattctaaaagcttctgctccttccttcccaatttctcctttgtagcaggaaattacacccagccctcatctcaattaatgctaaataaagctattgtttttccaaaacacaaatctacactgggtctcaatatcagtgatgaggcttacaaaccaacacgttttctgccatgaggatttctctttaggccagaagtacaaaacaaaaaaaccaatggattttaaccaaaatgatttgaaatataggtgaggattcaggagaaggcaaaagctagaaacacttggggttgtcaacatgagtattacattaacattgcttgatgagaacctctaatgatactgacaacataaattacctagggtaaaggatagctgcaacaatgaaacaggaaagaagagagggagagagaggaaagggaaggaagaaaggaaggagggagaagggaagaaagaaacaatgtctaacccaaccctatcttgaaagttgaactcaagtagaaaaatggatagaaacaaaattctctagtactcatccaggaaaccattcttcaatgttgcatgtggctgtttgccaaggcacacaaagtgcttgtaggcagcaaccatatgctacaagaattgtaaactgcatacagtttgtttgaagtagacagtgaggataataacaaagttgctaggcaggaaaaaaaatcaggaaaaaagcttgtcgctatttgagaatctgtatatttttaaaggcttaaaatattataaccacagggtatccagccaaattcaacattactgcaagtcttagagatttaaacattcatttgattcagagctaaatattcaccataatccaggagggtctccttccccactgcagaggcagaacgtccaagaatggagtaagattagtcatagtaaagtctcagtctgaatatttagcaagagaaacaggcagcagaggaacccaaaggcagtaaatcaaatattctaaaacccaaagttcattattttcatccaaaagactttcacagaaacacattactcacagccatgtatatcttggacagagtttcagatggaatgacttgtctgaaatttgtaaagcttaatataggttttgggggaattattttaatattcaaagaatgttttattatagtcctttgtgttaaaatttagccttactaattataacaataactcataaagttctaaattcagaaggaatgtctgttctttatcaagtgtatgtaactattttttagaaatgccatctactttctagaaacactaaagttattgttttctaagttaaataactataatttatatatctattaaaaaggtacttctcttcccaaa

SEQ ID NO: 1441 - DNA, 2108 bp, Homo sapiens
atgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaagggtgctgttttgttacattttacacccgtaaagctgcattagaagctcagaatgctcttcacaacatgaaagtcctcccagggatgcatcaccctatacagatgaaacctgctgacagtgagaagaacaatgcagtggaagacaggaagctgtttattggtatgatttccaagaagtgcactgaaaatgacatccgagtcatgttctcttcgtttggacagattgaagaatgccggatattgcggggacctgatggcctgagccgaggttgtgcatttgtgacttttacaacaagagccatggcacagacggctatcaaggcaatgcaccaagcacagaccatggagggttgctcatcacccatggtggtaaaatttgctgatacacagaaggacaaagaacagaagagaatggcccagcagctccagcagcagatgcagcaaatcagcgcagcatctgtgtggggaaaccttgctggtctaaatactcttggaccccagtatttagcactttatttgcagctccttcagcagactgcctcctctgggaacctcaacaccctgagcagcctccacccaatgggagggttgaatgcaatgcagttacagaatttggctgcactagctgctgcagctagtgcagctcagaacacaccaagtggtaccaatgctctcactacatccagcagtcccctcagcgtgctcactagttcagggtcctcacctagctctagcagcagtaattctgtcaaccccatagcctcacttggagccctgcagacattagctggagcaacggctggcctcaatgttggctctttggcaggaatggctgctttaaatggtggcctgggcagcagtggcctttccaatggcaccgggagcaccatggaggccctcactcaggcctactcgggtatccagcaatatgctgctgctgcgctccccactctgtacaaccagaatcttctgacacagcagagtattggtgctgctggaagccagaaggaaggtccagagggagccaacctgttcatctaccacctgccccaggagtttggtgatcaggacctgctgcagatgtttatgccctttgggaatgtcgtgtctgccaaggttttcatagacaagcagacaaacctgagcaagtgttttggttttgtaagttacgacaatcctgtttcggcccaagctgccatccagtccatgaacggctttcagattggcatgaagcggcttaaagtgcagctcaaacgttcgaagaatgacagcaagccctactgagcgtgctcccctctgagactggagtgagagggtcttctgattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaa

SEQ ID NO: 1442 - DNA, 10784 bp, Homo sapiens
gaggcggtggcggcggaggcggcaccgattgctgtgtcggccccagtgcggccgaagtcgcggtagagcgtagccccacgcccctcccccgtccgcgccctccctctttccctggggatggagaaggcgacggttccggtggcggcggcgacggctgcagaaggagaagggagccccccggcggtggcggctgtggcgggcccccccgcggcggcggaggtcggcggcggcgttggcggcagcagcagagctcgctcggcctcgtctcctcgtgggatggtgcgagtctgcgacctgctcctgaagaagaagccgccgcagcagcagcaccacaaggccaagcgtaaccggacttgccgaccccccagcagcagcgaaagcagcagcgacagcgacaacagcggcggcggtggaggcggcggtggaggcggaggtggcggcggcggcaccagcagtaacaacagcgaggaagaagaggacgacgacgacgaggaagaggaggtttctgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgttggatgaagctgctgctgcacttacccgtatgagagctgaaagcacagcaaatgcagggcagtcggacaaccgcagtttggcagaagcctgttcagaaggagatgtaaatgctgtgcgaaagttactcattgaagggcgaagtgtaaatgaacacacagaggaaggggagagcctcctttgtttagcttgttctgctggatactatgagcttgcacaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggacacttagagatggtgcgatttcttttggaagcaggcgcggatcaagagcataaaacagatgaaatgcacactgctctgatggaggcttgcatggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcagctcgagaaggacatgaagaaatggtggcattacttcttggtcaaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggagctaacgttcatgcaacaacagcaacaggggatacagcactaacatatgcctgtgaaaatggtcatactgatgtagcagatgtcttacttcaggcaggcgcagatctggaacatgaatctgaaggtggaagaactcctttaatgaaagctgcaagagctggtcatgtttgtactgttcagttcttaattagtaaaggagcgaatgtgaatagaaccacagctaataatgaccatactgtactgtccctggcttgtgcagggggtcatctggcagtggtggaactacttttggctcatggggcagatcctactcaccgtttgaaagatggctcaactatgttgatagaagcagcaaaaggtggccatacaagtgttgtttgctatctcttggattatcctaataacttgctttcagcccctccaccagatgtcactcagttaactcccccatcccacgatttaaatagggctcctcgtgtaccagttcaagcactgcccatggttgttccacctcaggagcctgacaaaccacctgccaatgttgccaccactcttcccatcaggaataaagctgcttctaaacaaaagtccagcagccatttgccagcaaacagccaggatgtacagggttacatcaccaatcagtctccagagagcattgtagaagaggctcagggaaagttaacagaactggaacagaggataaaagaagccatagaaaagaatgcacagctgcagtccttggaactggctcatgctgaccaacttaccaaggagaagatcgaggagctcaacaaaacaagggaggaacaaattcagaagaaacaaaagattttggaggaactacagaaagtagaacgagagttacaactgaaaactcagcagcagctaaaaaagcagtatctagaggttaaagctcaaagaattcaacttcagcaacagcagcaacagtcttgccaacacctgggattactaactcctgttggagttggagagcagctttctgagggagactatgcacggttacagcaagtggatcctgttttacttaaagatgaaccccagcagactgctgctcagatgggttttgcgccaatccagcctctggcgatgcctcaagctttgcctctggcggcaggtcccttgcctccagggtccatcgcaaatcttacagaactgcaaggagtgatagttggacagccagtactgggccaagcacagttggcagggctggggcaaggaattctgacagaaacacaacaagggttaatggtagccagccctgctcagaccctcaatgacacgctggatgacatcatggcagcagtcagtggaagagcatctgcaatgtcaaacactcctacccacagtattgctgcatccatttcccaacctcagactccaactccaagtcctatcatctctccttcagccatgcttcctatctaccctgccattgatattgatgcacagactgagagtaatcatgacacggcactaacacttgcctgtgctggtggccacgaggaactggtacaaacactgctagagagaggagctagtatagagcaccgagacaagaaaggttttactccactcatcttggctgccacagctggtcatgttggtgttgtggaaatattgctggacaatggtgcagacattgaagcccagtctgaaagaaccaaggacacaccactctccttggcttgttctgggggaagacaggaggtggtggagctattgttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggagatgctgaagaagtgtcatctttgtatggagtcaatagtacaagccaaagatagacaggctgctgaagcaaacaaaaacgccagcattttgttagaggagttagacttggaaaagttaagggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagaaggtgaatggagagtccaagagcagcagtaccagcgagagtggggacagtgataacatgaggatttccagctgcagcgatgaaagtagtaacagcaacagcagtcgtaagagtgacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtattgtcaatatggactcgccatatggttctgtaacaccttcttcaacacatttgggaaactttgcttcaaacatttcaggaggtcagatgtacggacctggggcaccccttggaggagcacccgcagctgctaactttaacagacaacatttttccccgcttagtttgttgactccgtgttcatcagcatcaaatgattcttctgcacagtcagtatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggtgtaaccctgggatgggaaatcctatgatccacagaccgatgtctgacccaggagtattttcacaacatcaagcaatggagcgagatagtacaggaattgtaactccttctggtacattccatcagcatgttcctgcaggctacatggactttcctaaagttgggggtatgcctttttctgtgtatgggaatgcaatgattcctccagtagcacctatccctgatggtgctggaggacccatatttaatggccctcatgctgcagacccttcttggaactcactgataaagatggtttccagctccacggaaaataatggccctcaaacggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacagacttatctcctcactcctttttctctccttacctttaccactaataccagtaaaattatctttctgatagtgaaaaggttctgtcaagattttcactgtaatggctgctacagagatggaccatcttcatcatcaccagtggtttcttctaattataaaatgtttaaactttctgagaatttaaaaagccaccactgttcccagtcagcatatacaagctcttaatattctgtttattaaataattcaatgtactattttatattggatgatattgattcttaacattggcttttcagtcatcaacagtcaacataaaaatttcaattttcagtaatttagtggaaaatatcttatttcttttttcaattttaaaggcttcctgcttttttacccttgtatattatcagtgaaaaggatcaacagttaatttgagccaagtaataaaagaaattctgcatttgtcacgaagacaatttatggtagacagataaatacacagattacagtgtaaagtctccatttaacctgtttataaaagatacaaggccacactaaactactcagtgggatttatatattccatccacttgaaacaataaacagtaatgtatccaagaagattatgtgtcctaccctgtctcatggaaaaattaattatatggttgaaatgtaaaagaaagtaagcataaaaatcgagtaatgtatatatcaatttgtcttctttttttttaattagacataaaatttcacactggtaaaacataaaaactaactaaaattcatataaatcacctagagttgatgatattaacatggttccttggttgtcaagtaaatcaaatgatttcttccatctgagtaaagagtaaagcctgagtaaagagtaaaaagatgacttctcaaacatatccagaaatttgtaaacagtacactcatatcttttagtttaagaagtggtcttaaaatatataaatttgtttttccacctatgtttaatatgcccaaatttaaagggagagctaaaagacagcctacaaataaatatagctatgaaataaaattatagcactttactaaaaaagggatgtaataatgttatttaacgaagtattttatatatgacttgccactattctatacataaaattttttttcttaattctttcctgtgttaactagggttattttctatttaaggtaatcctgctggagaacagatgctatccaatatttattacaacacatgagttgtgttgtttcacaatactgaatttcttaggtgaggtattttatttaaaaaggagggggaaaactcctatattttcttgacttcaaacctgtggggccaggggatatagattgaaatgctccgtatttagtcttggggatcaggcttgtttagtacaataccatggttttagaagtctgtactaggaacatttttaaaatacattttttatatttcagatgtaatgcagtgcacttttatttgaacaataaaaaaacccataactttttgagaccatgaaggtcttttattttttaattttgaaaatatgtggtatgtgtatatgcagactacatcattgttttaagaaatgatttaactcttggacattacacttgggttagttcacaccttaaatccccaagtagttaatatctcaattattgtataatcagtttataccatccattcccaacaaaattccacatttcatgccttttcaacatacatttcaacataatcaacatatttacaaacactgacttcactgtttataaagaagaaatttcccctcctatttcccattactgaaaagtcaagtcatttttattgatacatgaaaattaatttttttgtaaatgactacgtatagtcatttttctcctttggaaaaggtaaatagcttattaactaatcctgtcttgttcttcacaaaaataatagtccatccgtgttttgactcaaataacctaaatacacattttgtaaaaattttgtaccctatattacttatttttaaaacagtacagtgttagactaaacaggaaaactcaaagttataaaatctcttcagatcctctagtttattaaatctattttcatgttga

SEQ ID NO: 1443 - DNA, 6407 bp, Homo sapiens
atgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgagctcacgggcaagctgccagtagaatatcccctggatccaggggaggaaccacccattgttcggagaagaataggaacagccttcaaactggatgaacagaaaatcctgcccaaaggagaggaagctgagctggaacgcctggaacgagagtttgccattcagtcccagattacggaggccgcccgccgcctagccagtgaccccaacgtcagcaaaaaactgaagaaacaaaggaaaacctcgtatctgaatgcactgaagaaactgcaggagattgaaaatgcaatcaatgagaaccgcatcaagtctgggaagaaacccacccagagggcttcgctgatcatagacgatggaaacattgccagtgaagacagctccctctcagatgcccttgttcttgaggatgaagactctcaggttaccagcacaatatcccccctacattctcctcacaagggactccctcctcggccaccgtcgcacaacaggcctcctcctccccagtccctggagggactccgacagatgcactatcaccgcaacgactatgacaagtcacccatcaagcccaaaatgtggagtgagtcctctttagatgaaccctatgagaaggtcaagaagcgctcctctcacagccattccagcagccacaagcgcttccccagcacaggaagctgtgcggaagccggcggaggaagcaactccttgcagaacagccccatccgcggcctcccgcactggaactcccagtccagcatgccgtccacgccagacctgcgggtccggagtccccactacgtccattccacgaggtcggtggacatcagccccacccgactgcacagcctcgcactgcactttaggcaccggagctccagcctggagtcccagggcaagctcctgggctcggaaaacgacaccgggagccccgacttctacaccccgcggactcgtagcagcaacggctcagaccccatggacgactgctcgtcgtgcaccagccactcgagctcggagcactactacccggcgcagatgaacgccaactactccacgctggccgaggactcgccgtccaaggcgcgccagaggcagaggcagcggcagcgggcggcgggcgcactgggctcagccagctcgggcagcatgcccaacctggcggcgcgcgggggtgcggggggcgcggggggcgcggggggcggtgtgtacctgcacagccagagccagcccagctcgcagtaccgcatcaaggagtacccgctgtacatcgagggcggcgccacgcccgtggtggtgcgcagcctggagagcgaccaggagggccactacagcgtcaaggctcagttcaagacgtccaactcctacacggcgggcggcctgttcaaggagagctggcgcggcggcggcggcgacgagggcgacacgggccgcctgacgccgtcgcgatcgcagatcctgcggactccgtcgctgggccgcgagggcgcccacgacaagggcgcgggccgtgccgccgtctcagacgagctgcgccagtggtaccagcgttccaccgcctcgcacaaggagcacagccgcctgtcgcacaccagctccacctcctcggacagcggctcgcagtacagcacctcctcccagagcaccttcgtggcgcacagcagggtcaccaggatgccccagatgtgcaaggccacgtcagctgccttacctcaaagccagagaagctcgacaccgtcaagtgaaattggagccacccccccaagcagcccccaccacatcctaacctggcagactggagaagcaacagaaaactcacccattctggatgggtctgagtctccacctcaccaaagtactgatgaatagaggagctacaatgatagctgtttcctggattcctccctctatccagaactagctgatgtccagtggtacgggcaggaaaaagccaagcccgggaccctcgtgtgagccagcccggcctaatctgaccgcctcaacgccattctgagatcacctcactgcctctcatttgccttacccagacgcaccgtcaccctgcaccagctttggccctcagcactttttttctcctgtctccgcattccctcccccttgaaaacctgactgaggagacattctggaaggttccggtcccactgtgtgtcccctggcgctcttgcccatagagagccagacaccaatcctcaatggcaccttggtggcttccctctgccatgacagcccctaggccaggaaccatcaggggggccagccggcatccaattcctgcggataagtagcgttgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgcatcggaggaccacaatcagttctatgctgccaaagattaaaaataaataaaaacataaaaaattaagaggggccaagaggaagacattctttctgcaaggaaatttcttttaaattctgaactgctactacacacaagtgaaagtcaaccctatgtaaactggtgtcctctctctagccctctcccttactggcccacttctctctccgtagagagcctgaaaaactgccccaatgccacggtaaaggcgaggaagtcttggctggcgttgctgactcacagtcgccatccatctggacacaaagagagacctgtgggagtcgtagagggtactgttagccccggtccatgcagggggttcagccgagcccaagactcaaagctgctttcctttcaggatttgtagtaacgtaaggtgataatggccaaaagtggttctctctcattaaaccaaccagtaaaagcgtatcctatttttttgcacaaggtgtttcattttcgtttttatgggaaaccaagggaaaagcacattgcgatccattcagtgtttaactgtcgtggctcattttctgttcgttagcacttgtgtgacaaaagagctcagatccgacttctcctatgtgtcacttattccaagaacccaactatgcccttaggtagaaagatttgactcgtgtgtctactagccaacaggcagagcagggttgaaaaaaatatcagctcccaaagggcccatgtgtctacatcatcagttactgtcatgcaccacatttgtgtgcagataccaaaagaggaggaaagaagaaaaaaattaatgtgtgggagctgcacgtttacatgttttgagctatgcttcaaacacaactggaaagccatcaatcttcaaaggcctcaaaaatacttttatagtaacaagtgcacgactttagttgggttattcaagatggcacaaaaaggtttccgcagaggtggtatgctgtgcttttggcgcaagtggtggggggatggggtgggggtggaatttttttctcactctaatgacttcctattggaaaggcattgacagccagggacaggagccagggtgggggtagttttgtgggaaagcagaactgaagttagcttaagcataaaaacaaagaaaaatcttcgcttttcatgtatgtggaatccaagaataaccataggctctaccagaccagaagggtaaggatggacactaaaatgaaacaaataccaaggtattccttctgctgcagcctggagaccaccgagagtcgagctggggcacacacacacctggccgggacccggcagggacaaggcgggccgtggcctcctccaccaagtctctctagacaattcagggcctgctttccccagctccatgcatggctggactggtgattccagggtgcagaagggattcatattcccagaacgctttaagtgtacacctgcaggataaagagataccggttacattattaaatgattctagggattcactgggggatatttttgttgcttttactttcatggttagagctacaaagaacagtgattttttttttttctcccttccccattcagaaacattatacattgggccatttttctttctcccaaagaagattcatggatagtcagactgaactgtgtgcaacaggaaaagtcaaaagggaaaaggtagctgatgaggttacatggttacatgttctacatcatgcatagtagcttgaaatctagtctggagaaaactggatcaagattctagcccactggagttgcaaggaatgagaggcaaaaattctaaagatttgggttatattttcaacttgggggacagagagaaatggagagcaggaattacagttccaacaaacatcatgatagtctggtagtcaagacagagattaagtaaaacaggttttactgtttagctgagttcagttaatacaaaatgtacataaaacgttagtcctttgagactgacatgattaatgatcagtgtggtgggaaatgatgtagttattgtacacaagcacttgcaaactctttatccctatttctttaaaacaaaataaggtgaaatacgaagtccttggtctgatataaagcccctattggattcttcggatgcgtaaaagaaattgcctgtttcagccagaagactggtgaaaacacatacatcagactatgttgtgagccaggttgattttttattttattatatgcaggtgagtgttgaaactgttaaaattccaatttgttttcattcagtattagtttagttctaaatatagcaaaccccatccaggtgctatcagatgaccagttactgcttagttaactaggtgtaaagttttacatatacattaatgtcaatagtttattacaagttgtgtaaaatggactctagtttaataatgggggaaaaaagattaggttgctcctgaaactgactgtagagcatgtaaaatgattttactggattctgttcaactgtaatcaatgaaaaagatgtacgttgtagacaaagttgcagaattaaaaaaagaaatctgcttttaatttattctttttgtattaagaatttgtatagtacctttacattttgcaaaacagtgttgtcaacacttattaaagcattttcaaaatgaaaaga

SEQ ID NO: 1444 - DNA, 2619 bp, Homo sapiens
agtccctttttcttgagagagtgtggctctgtcaccaaggctggagtgcaggggcacaatctcagctcactgcaacctccaccttgcgtgtctcagcctcctgagcagctgggaccacaggagtgtgccaccacacccagctaatttttgtatttttttagtagagatggggtgtcaccatgttggccaggctggtctcaaactctcggcctcagcctcccaaagtgctgggattataggtgtgagccaccacacccagcctctatatcccttttatcggtggacccaacaatcttctgtagacagaagactgtgtgaataagccaatggtcccaagagagcacgcatcctaatgagaacggagacagataataaagagggaaacaagtaaaccaactatcaatgattaggagcgtcagatagagccaggtgcagcctggacaacatgatgagatccccatctctaaaaatataaaataaattagctggtcatgatggtgcacacctgtagccccagcttctcagtaggctgaggtgggaggattgcttaagcctgggaggtcaagcctacagtgagccatgatctcaccatgcactccagcctagacaacagggcaaggccctctaaaaaaaaaaatgaaaagatagcatgctttggccggatgtggtggctcacgcctgtaatcccagcacttcaggaggttgaggcgggcagatcacctgaggtcaggagtacgagatcagcctggccaacacggtgaaaccccatctctactaaaaatacaaaattaactgggcgtggtggctcatgcctgtaatcccagctactctggaggctgaggcaggagaatcgcttgaacccaggaggcggaggttgtggtgagctgagattgcgccattgcactccagcctgggcaacaagagcgaaactccgtctcaaaaaaggatagcatgcttcataaacggtgaaatgacatgcaaaggccatagttgtcaagcaccagtaacaccagagagtggcctgtctttccttcaagcagaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgagcactttgggaggcccagatggggaggatcacttgacccaggagttcaagaccagcctggccaacatggtgaaaccccatctctactaaaaataccaaaatgagccaggcatggtggcacacgtctgtaagcccagctactcaggaggccaaggcaggaggattgcttcaacccaggaggcagaggttgtggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccagtgcaggctgcagatgattcagttgaggaagtgtcagctggagtccggggcttgtcaggagatggcttctgtgctcggcaccaacccacatctggttgagttggacctgacaggaaatgcactggaggatttgggcctgaggttactatgccagggactgaggcacccagtctgcagactacggactttgtggctgaagatctgccgcctcactgctgctgcctgtgacgagctggcctcaactctcagtgtgaaccagagcctgagagagctggacctgagcctgaatgagctgggggacctcggggtgctgctgctgtgtgagggcctcaggcatcccacgtgcaagctccagaccctgcggctggatagctgtggcctcacagccaaggcttgtgagaatctttacttcaccctggggatcaaccagaccttgaccgacctttacctgaccaacaacgccctaggggacacaggtgtccgactgctttgcaagcggctgagccatcctggctgcaaactccgagtcctctggttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccaggcatggtggcgggcacctgtagtcccagctactcaggaggctgaggcaggagaatcgcttgaacccgggaggtggaggttgcagtgagccgagatcgcgccactgcactccagcctgggcgacagagtgggactccatctc

SEQ ID NO: 1445 - DNA, 1202 bp, Homo sapiens
tgggcggggttatataagccagcggcgggcggaaggcggggcgtgggggtctgtggctgctgggctggcggggcgcaggccgcgggacccgagcccggggaagcgagagagcggaggcgccgaggatccgattcactccctggggagacctatgggccgaagccgtgtaaatgcgttttaagcagaggcctcggctccgcaactgccactcctcctcggggtgttgcacaagtttcgaggtcaccggcgaccccccctagcagcgcgcctggctctggcccccgcgaaggaggacggagtttggagcttgcggcccccacccaccgcgtggcgtccccaggcacgcctagaattctagcacctcaggatcagtccagcccccatttacaattggggaaactgcggctccgaaagggtcagagggtacccgaggtcaagcagtagagagcggactcgaacttaagctcttgctcttaggctgagacgccttgatgtggccaccggctaccctctagtgtgttgcatactttctaaggcggcggctgcagcagcggctccatccagcccgtcagctcctcctgcaaggcatggctggctacctgagtgaatcggactttgtgatggtggaggagggcttcagtacccgagacctgctgaaggaactcactctgggggcctcacaggccaccacggacgaggtagctgccttcttcgtggctgacctgggtgccatagtgaggaagcacttttgctttctgaagtgcctgccacgagtccggcccttttatgctgtcaagtgcaacagcagcccaggtgtgctgaaggttctggcccagctggggctgggctttagctgtgccaacaagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagtctaagaaccactcaccctgctacatgtctctagagtccattcatttcattgccgtgtag

SEQ ID NO: 1446 - DNA, 1364 bp, Homo sapiens
gccttacgccgctgacgcatcgcgcccaagatggcggcgcggtcgtcgtcgggggtggcggcggcagagggggcggcggccctggcggcagcggagacggcagccgtgacggtggcagcggcggcgcgggacctgggcctgggggaatgaggcggccgcggcgggccagcggcggagccgtgtagcggagaagctccccctccctgcttcccttggccgagccgggggcgcgcgcgcacgcggccgtccagagcgggctccccacccctcgactcctgcgacccgcaccgcacccccacccgggcccggaggatgatgaagctcaagtcgaaccagacccgcacctacgacggcgacggctacaagaagcgggccgcatgcctgtgtttccgcagcgagagcgaggaggaggtgctactcgtgagcagtagtcgccatccagacagatggattgtccctggaggaggcatggagcccgaggaggagccaagtgtggcagcagttcgtgaagtctgtgaggaggctggagtaaaagggacattgggaagattagttggaatttttgagaaccaggagaggaagcacaggacgtatgtctatgtgctcattgtcactgaagtgctggaagactgggaagattcagttaacattggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcgatgtcaggcatcagatgactgaagacttcctgtaagagaaatggaaattggaaactagactgaagtgcaaatcttccctctcaccctggctctttccacttctcacaggcctcctctttcaaataaggcatggtgggcagcaaagaaagggtgtattgataatgttgctgtttggtgttaagtgatggggctttttcttctgtttttattgagggtgggggttgggtgtgtaatttgtaagtacttttgtgcatgatctgtccctccctcttcccacccctgcagtcctctgaagagaggccaacagccttcccctgccttggattctgaagtgttcctgtttgtcttatcctggccctggccagacgttttctttgatttttaattttttttttttattaaaagataccagtatgagatgaaaacttccaataatttgtcctataatgtgctgtacagttcagtagagtggtcactttcactgcagtatacatttatctacacattatatatcggacatataatatgtaaataaatgacttctagaaaga

SEQ ID NO: 1447 - DNA, 5880 bp, Homo sapiens
gctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattctggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattcttt

SEQ ID NO: 1448 - DNA, 1194 bp, Homo sapiens
atgggggactcttgccctgcagtcacattcaggtcccagaaagagaatcgagctggacttcaggagaagctgcgctacctccagcagcagctgcaggatgagacgccgcgacggcaggaggccgagctgcaggagccggaggagaagcaggagccggaggagaagcaggagccggaggagaagcagaagccggaggctggcctctcctggaacagcctgggccccgccgccacgtcccagggctgccccggcccgccagggagtcccgacaaaccctcgcggccacacggcctggtccccgcaggctggggaatggggcctcgggctggcgagggcccctacgtgagcgagcaggaattgcagaagctgttcaccggcatcgaagagctgaggagagaggtgtcctcactgaccgcccggtggcatcaggaggagggggcggtgcaggaagccctgcggctgctcgggggcctgggcggcagggtcgacggcttcctaggccagtgggagcgggcacagcgcgaacaggcacagacggcgcgggacttgcaggagctgcgaggtcgggcggatgagctgtgcaccatggtggagcggtcagcagtgtctgtggcttcactgaggagcgaactggaggggctgggcccactgaaacccattctggaggagttcgggcggcaatttcagaactctcgaagagggcctgacctctccatgaacctggatcggtcccaccaaggcaactgtgcccgctgtgccagccaggggtcgcagttgtctacggagtccctgcagcagctgctggaccgagcactgacctcactagtggacgaggtgaagcagaggggcctgactcctgcctgtcccagctgtcagaggctacacaagaagattctggagctggagcgccaggccttagccaaacacgtcagggcagaggccctgagctccacccttcggctggcccaagacgaggccctgcgggccaagaacctactgctgacagacaagatgaagccagaggagaagatggccactctggaccatctacacttgaagatgtgctccctccacgatcatctcagcaacctgccacttgaggggtccacgggaacaatggggggaggcagcagtgcaggaacccccccaaaacaggggggctcagcccctgaacaataaatggcctctcatgct

SEQ ID NO: 1449 - DNA, 4050 bp, Homo sapiens
gtactcggccgcctgagcgccgacccacgccctgcctgctcttccagtccagccaacactctaagcaggcaccgcctccactcgcagcccccgggatgggtcccactccctaccgcagatccccaggccccctccacccagtcggctagccctcgcctctgccatccgatactaaaatgtctgatgatgctggtgacaccttagccactggagacaaagcagaagttactgagatgcctaatagtgattctttacctgaggatgcagaagtgcattgtgattcagctgcagtttcacatgagccaacaccagctgaccccagaggggaggggcatgaaaatgcagctgtgcagggtgcaggggctgccgccattgggccccctgtgcagcctcaggatgccaacgccctggagccccctctcaatggagacgtgactgaggatacacttgctgaatgtattgattccgtcagccttgaggcagaacccagatccgaaatacccctgcaagaacagaattatctggctgtggattcccctccaagtggaggaggatgggcaggctggggatcctggggcaaatctctgctgtcgtcagcatctgccacagtaggtcatggattgacggcagtcaaggaaaaagcaggagccactctacggattcatggtgtaaattctggatcttctgaaggagcccaaccaaatactgaaaacggagtccctgaaataacagatgcagccacagatcagggccctgcagaaagcccacccacttccccttcatcagcctctcggggtatgctgtctgccatcaccaatgtggttcaaaacacaggtaaaagtgtcttaactggaggccttgatgcgttggaattcatcggcaagaaaaccatgaatgtccttgcagaaagtgacccgggctttaagcggaccaagacgctcatggagagaactgtttccttgtctcagatgttaagggaagctaaggagaaggagaagcagagactggcacagcagctcacgatggagagaaccgcgcactacgggatgctgtttgatgaatatcaaggcttgtcacacctggaagccctggaaattctgtccaatgaaagcgaaagcaaggttcagtcatttttagcatcacttgatggagagaagctggaactcttaaaaaatgacctaatttccattaaagacatctttgcagccaaagaattagagaatgaagaaaatcaagaagaacaaggcttagaagaaaagggagaagaatttgctcgcatgcttacagagcttctctttgaattacatgtggcggccacacctgacaaactcaataaggccatgaagagggctcatgactgggtggaagaggatcaaaccgtggtgtcagtagatgtggcaaaagtgtccgaagaagaaacaaagaaggaagaaaaggaagagaaatctcaagaccctcaagaagacaaaaaggaggaaaagaaaactaagaccatagaggaagtatacatgtcgtccattgaaagtctggcggaggtaacagcgcgctgtattgagcagcttcataaagtagcagaattaattcttcatggacaagaagaggaaaaaccagctcaggaccaagcaaaagttctaataaaattaactactgcaatgtgcaatgaagtggcctctttatcaaagaagtttacgaattctttaaccactgttgggagcaacaagaaggccgaggtccttaaccccatgatcagtagtgtattgttagagggctgcaacagtacaacgtacatacaggatgccttccagctgctgctgcctgttctgcaggtctcacatatccagaccagttgtttgaaagcacagccgtgacctggccagactccatctagttaaaggagacagctggccgccttgcctcaatatgtaccatttaaggggatgttctctgtgcgcctggccacagacatccatttgaggacactacaagcaattttgcacagacaatattgagaatgcaaatttagagagagttatcatttctctcaatgtgtataattgtttttacaaacaattgtgttttctttatgttaatttaaacttacacagcttatattgaaaatttcctttcatctgaaatttatttacaaatattcgtgttcattttcctggttaagcatgctatatttagaaactcatggggagaccttagacttttgtttaatcctttatgtttcaacctttaaatgttccattcttatagtattactttaaatcaattctaaaactgaactttgttttgttacataaatgtcgcaggcaaaaataacactacttatagattttacctattatggtaaaaaataggaacatattgtcattctttttttttttttttttttgagacagagtctcactctgtcgccaggctggagtgcgttggcacaatctcggctcactgcaacctccgcctcctgggttcaatcgattctcctgcctcagcctcctgagtagctgggactacaggtgtgtgccaccacgcccagccaattttttttgtatttttagtagagacagggtttcaccatgttggccaggatggtctcgatctcctgacctcgtgatctgcccgcctcagcctcccaaagtgctgggattacaggcttgagccaccgcgcccggccggtcattcattcttgcaacaagcatttattgagcacctactgtgtgctcacagtaaagaaacgtgatcttatcccagtagaggtagatattctgaaaaagaataattcttaaactgcttaaaacaggggtccccacccccaggccacagaccagtaccagtccgtggcactggttaggaaccaggccacacagcagggggtgagcggtgggtgagtgagcacagcttcatctgtatttacagctgctccccagagcttgcattactgcctgagctctgcctcccgtcaggtcagcagcagcattagagtctcatgggagtgcgaaccctgttgtgaactgcacatgcgagggatctaggttgtgcactccttatgagaatctaatgcctgatgaatctaatgcctcatgatctgaggttgaatagcttcgtgccgaaaccatcccccacccccatcccgctaccccgagtccgtgaaaaaattgtcttccatgaaaccggtccctggtaccagaaaggttggggaccactggcttaaaataccaataaatttttgaaccttaaaaactttgaagaacaaggtaaattggtgttttatttaatgtcctaccctttaatttgttgcattttcctatactctttacactattttatcccaaactatgtatatgaggtgaaaatatatatgaaaagggatactgaagaatatttagtttaaaattaatttcttacgatcacgagcacatggtggcataattacaaagcttggaagtattcaaatagaaaatcaaaggtgtttcaatacagtagaatcccaggactgcattttaaaatcgcctcacagatcacactcgctggtggcaaatatcatcatcgttgctaaaggacagaaaatactgatgtgtgttttaactaactggtatattgatccatgggaggctgcacagaagaccctgcggccaggaggggcattgtcagtggctgcttctcctgagctccacgccttcattgcagctgcatgttcgatacaatacacctgcttcacagccccatggacatccctacaggtactgtcatgtgaagccttgcctagtagttctctccagggcaaatgaagctcacagttttgcaaggtggaaacctcttattcacatttgctttgattccccgatggagtagactgcctttgttccatacaggcaaagtaaggatattttaatatcatcctacttcttattagcatttcatttgtctatgtactgtatttcatttgtatgtctcctgaaacatccaaatagagaacataagaacactttatgtacaatctggaaaaaaattacctgagaaatcaattaaagatttttccccttt

SEQ ID NO: 1450 - DNA, 3750 bp, Homo sapiens
ggctagacccctcccctccttgcgagtgtatgtcagtgacccagaggcggtgtgaggcggagggaccgtcggggggcgccgccgccgcctccactagcagcagcggcagcagccctagtcccgcggtgcggtcgaattggtccccagccctccgggagcgcaccacaaagcagccccaacgcctctccctgcgtccgcggctcctcagcgctcggctccgtggtcaacttcccctcgctgggctcggctggcgggcgcggagggcagcggcggaacggcgggctgtctgctcgcgctccccgcgcacaacacttcaccctctcgcctcgggtctcgggggccgctctgggatcccggccaccagcaattgtccggaaataatgcaaaaggtgtcccaaggctcctgaccagtgaacaaagatttgagaaagacagccaagctcatgttttctcctgatcaagaaaatcatccatctaaagcaccagtaaaatatggtgaactcattgtcttagggtataatgggtctctcccaaatggcgatagaggaaggaggaaaagtaggtttgctttgtttaaaagacctaaggcaaatggggtgaagcccagcactgtgcatattgcttgtactcctcaggctgcaaaggcaataagcaacaaagaccagcatagcatatcatatactttatctcgggcccagactgtggtggttgaatatactcatgacagcaacaccgatatgtttcagattggccggtcgactgaaagccccattgattttgtagtaactgacacggttcctggaagtcaaagtaattctgatacacagtcagtacaaagcactatatcaagatttgcctgcagaatcatatgtgaacggaatcctccctttacagcacggatttatgctgcaggatttgactcatcaaaaaacatctttcttggggagaaggctgccaaatggaagacatcagatggacagatggatggcttgaccactaatggtgttcttgtgatgcatccacgcaatgggttcacagaagactccaagcctggaatatggagagaaatatcggtgtgtggaaatgtatttagcctacgtgaaaccagatcggctcagcagagaggaaaaatggtggaaattgaaaccaatcagttacaagatggctcgttaattgacctctgtggtgcaacattgttatggcgtactgcagaaggcctttcccacactcctaccgtgaagcatttagaagctttaagacaggaaatcaatgcagcacgacctcagtgccctgtagggttcaacacactagcatttcctagtatgaagaggaaagacgttgtagatgaaaaacaaccatgggtatatctaaactgcggccatgtacatggctatcataactggggaaacaaagaagaacgtgatggaaaagatcgtgaatgtcctatgtgtaggtctgttggtccctatgttcctctgtggcttggatgtgaagctggattttatgtggacgccggccctccaacccatgcgtttagcccgtgtgggcatgtgtgttcagaaaagacaactgcctattggtcccagatcccacttcctcatggtactcatacttttcatgcagcctgtcccttttgtgcacatcagttggctggtgaacaaggctacatcagacttatttttcaaggacctctagactaacagaccattgtcttgcaggactacattataaatttataagctaagtgagttgggttttcgaacctgttgtccacgtcacagtttttctgctctggtcatttgcattaagatgaagaattttttaaaacatttataataaatagtagcaatttctgagcaaaaatctgggaaactcaagcaaaggaatttctgaaagtatcagtcttctgaattctgagttttgaaaatatattttgaggagaaaaagacatagtctaatttgatgccttccttttagtgtttttgaatcacctatcctcagtgctgaaattgttttgtataactgagggtactgttggttcaaactatgttagtttacagtttgttgcaaacattgtaaaatacagcgacatgtatattaacttttttctatttatctttattatagaaaataccttagaatgttcttgatagagtagcatggtaacgatggtgtcacacccttggtgtgaatggtagcttagtgagcaacctagctcaaggatttgcaaagttaggaagaaggacgagagagcctctctccccaccccaatctaaatatggaatttggtaaattagaatactttgtaatttgtaagaccaaattcatactaattacccgcgtgaaaggtgtttgtttttaacaacattgaagataatcaggaaagattttttcttaatgtttctctcgagcgtagtactataacaaaaacttaatgctaagaaacattttatatgctcctttggatatgcaatttaatctagattatctatttttctcccatgataactaatctgtttttagtatcagcagcatttggcaagtttattttttggatataaactgtggttcatctgttcactgtttctagaaaaaaatcattgccataagaaaaagtataaattagcaagaaaggagagtgacttgatttgcttttggaaaaagaaatgcttaattaattattctgtatttggccttattcgggcattaggaaatctagagatctaaagggttgaatgacaatagtgcccccgtttttagcagaccagccttaactctgggtttgaatcctaaggagattgccacagtgagacttaaggaaatgtttggttggcagatgagcaccaatgactgcagcgtggagtgacgcactgcatggtctgtttattctctaattccaatatgtcttttgcttccagaagcaagaaaagtttcttctctcccctccttcccacccttttttcaaaggcaccacaagtatagacagttgcactacatcaaatctttttttgacacttgtagaaaccagtacacttttagattagacagtatcttcttttaatattttgatttgttttcctttagtttgaaaagttgtataatacttaactgactgtagcaaagttttatatgtggtagcatacctttaatttatcctattacaaaactgttctgaattttcttttggtttttaaaaaacaaaacttgttgcttagaagccatgaattattttattttacttcaactgtcgaaacttccttgttttaaaaaatgatcatttgggttcactcaggaaatgcatgtcaggaaacttgtattataagtttattagttgtgatgtatcagtaactgctgttacccctttttcaaagaaatgtaattgattttgaagttttctagattgtcacatgctttgtgactaatgcaagaaagcaagtcctgtgttgtatttgttctagtcatttttattcaggctatatattgtagcttaatttttatttgcaattaatttatttaaactaagtaaatacttttcaaaatacataattgaattcgtctctgtgagttcatttttgcataatcgagaatgagaaaccagaagtgaaaactgtgaacaactctattccacactccaaaaatactcatttgaaatagatgaagagtttgcatttaatgtaacactttaaagtatctggttcttttttaaaagcatctcttactaataaaggaactttgttagtggttgaataa

SEQ ID NO: 1451 - DNA, 6013 bp, Homo sapiens
aaaaataatgccatttttttgaatgatgaactatggtataatgcatttagtgttcattccaaacgtcaatcaataaataacatgggcctctagctataagggaaattctataggtaaaagaactgattgacccccacccccataggtgctgtcctgctatggaatccctttgctcagttttctcctgtccaatcaggtggaatgtttcacaggcacatggtttatacagctcaaaataacttgggacctgtgagctgacaaatgctctggctccggtggtgacaggttgtccagcttcttacagccatcttcactgaaactaaggttaactcctcactctctatggacggctactctctatttccaagggcgtgaagaatttccctcttctcctgtgctttcatctaaaagttctccctggataattatcattgcagtggagtgcctggattggacatcctcatctgggtcaactaaaaaaagaaagcatgcaagacgacagcatagaagcttctacttccatatctcagcttctaagagagagctatttagctgaaaccagacatcggggaaacaatgagaggagtcgagcggagccctcctccaacccttgccatttcggcagtccttctggggccgctgaaggaggcggaggccaagatgaccttccagatctttcagcctttctgagccaagaagaattagacgaaagtgtcaatttggcaagactggccatcaattacgaccctttggagaaggcagatgaaactcaagctagaaaacgactttctcctgatcagatgaaacactcacctaatttaagttttgagcctaacttctgccaggataaccctcgaagtcccaccagctctaaagaaagcccccaggaggcaaaaaggccacagtattgttctgaaacccagtccaaaaaagtatttttaaataaggctgccgacttcattgaagagctatcctcccttttcaaatcccacagctccaaaaggattagacctcgtgcctgcaaaaaccacaagagtaaactggaatctcaaaacaaagttatgcaggaaaacagctccagtttctcagatctgtcagaaagacgagaaagatcttctgttcccatccctatccctgcggataccagggataatgaagtgaatcacgccctggaacagcaggaagccaagaggcgtgaagcggagcaggctgccagtgaggcggctggtggagacactacaccagggtcttccccttcatctctgtactatgaagaacctctggggcaacctccccggttcactcaaaagttacggagcagagaagttccagaaggaactcgagtacagttggattgcatagtggtaggaattccaccacctcaagtaaggtggtactgtgaaggcaaggagcttgaaaattccccagatattcacatcgtccaggcaggaaatctgcactcactgaccattgcggaagcctttgaagaggacacaggacgctattcctgctttgcttctaacatctatgggacagattcgacttctgctgagatttatatagaaggggtttcttcttctgactcagaaggcgaccctaacaaggaagagatgaatcgaatccagaagccaaatgaggtgtcatctcctcccactacctctgcagtcattcctccagcagtaccccaagcccagcatttggtggcccaacctcgtgtggcaaccatccagcagtgtcagagccccaccaattacttgcagggattggatggaaaacctatcattgcagctcctgtgtttacaaagatgctacaaaatttgtcagcttctgagggtcagctggttgtctttgaatgcagagtaaaaggagctccatctcctaaggttgagtggtatagagaagggactttaatagaagattctccagattttaggattttacagaaaaaacctcgatccatggcagagccagaggagatttgcaccttggtcattgctgaggtgtttgcagaagattctgggtgcttcacatgtactgcaagcaacaaatacggcacagtgtcaagcattgcacagctgcacgtgagaggaaatgaggacctcagcaacaacgggtctcttcactcagccaactctaccaccaacctggcagctattgagccacagccctccccaccccactcagagcctccatctgtggaacaaccccccaaacccaaactcgagggggttctggtgaaccacaatgagccccggtccagctccaggattgggcttcgtgtgcacttcaacctgcctgaagatgacaaaggaagtgaagcatcctccgaggctggtgtggtgaccaccagacagaccaggcccgattctttccaggagaggttcaacggacaggcaacaaaaaccccagagccttcttcccccgtgaaagagccccctccagttctggccaaacccaaacttgattccactcagttacaacagcttcataaccaagtcttactggaacaacaccaattgcaaaacccacctccttcatctcctaaggagtttcctttcagcatgactgttttgaactccaatgctcccccagcggtgacaacatccagtaagcaggtgaaggctccttcatcacagacgttcagcttggcccggccgaagtatttcttcccctccacgaacaccaccgcagcaactgtggccccttccagctctccggtgttcactttgagcagcactcctcaaactattcagaggacagtgagcaaagaaagcctcttagtgtctcacccctctgtgcaaaccaaatctccaggagggctttccatccaaaatgagccactcccaccaggcccaacagaaccaacaccaccaccattcacattttccatccccagcggaaaccagtttcagccccgctgtgtgtccccaattcctgtctctcctaccagccggattcagaacccagtggctttcctcagctctgttctgccttctctccctgccatcccacccacaaatgccatggggctgcctagaagtgcaccatccatgccatcccagggattagcgaagaaaaatacaaagtctcctcaaccagtgaatgatgataacattcgtgaaactaagaacgcagtgattcgagacttggggaaaaaaataactttcagtgatgtcagaccaaaccagcaggagtacaaaatttcaagctttgagcagaggctgatgaatgaaatagagtttcgcttggaacgtactcctgttgatgaatcagatgatgaaattcaacatgatgagatccccacgggcaagtgtattgctcccatctttgacaagagactcaagcacttccgggtcacagaaggctctccagttacattcacctgcaaaattgttgggatacctgttccaaaggtttactggttcaaagatgggaagcagatttctaagagaaatgagcactgcaaaatgaggcgagaaggagatgggacatgctctctgcacattgaatccactaccagtgatgacgatggcaactacaccatcatggcagccaacccccaggggagaatcagctgttctggccacttgatggtacaaagtttgcccattcgcagtcggctaacctctgctggtcagtctcacaggggaagatcccgagtgcaagaaagagacaaagagcccctacaggaacgctttttccgaccacatttcctgcaggctcctggggatatggtagctcatgaggggcgcctctgtcggctggactgtaaggtgagtggtttaccgcccccggagctgacatggctactcaatggccaacctgtgctaccagatgcctcccacaagatgctggtcagggagaccggagtccactctctgctcattgacccactcactcagcgcgacgcagggacctataagtgcatcgctaccaacaaaaccgggcagaattcttttagtctggagctctctgtagtagccaaagaggtgaagaaagcacctgtgatcctggagaaactacagaactgcggtgttcccgaaggccaccccgtgagactggagtgccgcgtgataggcatgcccccacctgtgttctactggaagaaagacaatgagaccatcccttgcaccagagagaggatcagtatgcaccaggacacaacagggtatgcctgccttctcattcagccagccaagaaatcagacgctggatggtacacgttgtcagccaagaatgaagccggcatcgtgtcgtgcactgccaggctggatatatacgctcagtggcaccatcagatcccaccgcccatgtctgtccggcccagtggcagtcgctacggatctctcaccagtaaaggacttgacatattttctgccttttcctccatggaaagcacgatggtgtattcatgctcttctcggagtgtagtggagagtgatgaactttaagaatgtctaggtacctgctgtgtaagagagcggactgtggagggggaatgagaacaagccagacttggtggtttccaagcaaccgaagttgagtaagttcccacactgctggacctgtggcaaagagtgctttgaataagtcagctagggattcttgcagtctcagctgagggagaaaggtagggctgtgccttctaaagattccaacagagatgtgagaagataatacagatgaaccaaagatgtcacacagttgccatccactgctttgggaaaaaactagcatgctcccctgctccctgttgtgttagggatgtttaggtcatactaggagcaattaggagccatatgcctgggctgagaagagctaggcagtagtgaccttaggatatgactaactcaccaaacaatgccaaggagaaaggcggacaggtcaccatcacctttcatcgattacatgtatagcagtagttttggtgaattcaccaaatcagcttccacttagcattaggaggtcatgccatacaactcacgtatgcgggcaaacacttttgatttgcatatcctgggtgtactgagccacataataaggtgtcaaaatgtgcttgagattccaaaaacttgctgaaacacttgatattgcacagtgcacttattttgtggccaaagcatggccttaccagcttgtctgcactattttcttttgggtggtgactgtttttttctgactttgcatatccctagacactagaactaaaggattggtaataaaccaatcagaaagaaatcctctgtggggtcactttaaaaactactagcttcaactaccacttacaaaatgtgcaagagtcatcatttgcccataaaatacacctcatgggctcctacccctttccccaaaagtctgaaagtgtaggaggaaggaagagatacaaacaaggagaggaaatgatgggagagtgttgtttttgtcacttgccccagcagagcaggggttttggaaggagaggtctttaatagctttgaaatgctttgagatcattggtcaaattgcattttctatgtagagaatattctgctaggtggaaaagttgggagaaaggggaatatgcatctttattctaatcaccaattcaaaccctgcctcttaaggaatttttagacttaagttcactgtgatatccctagtacctagaagagtacctagcacaaagtagacattcaataaatatttgctggttgaatgaatcttctgttattatgtctattataagataacctaatcttatattctgcaggaatatgccacccacacaccagtccaaacactgccctgggaatgctcatcacagcacagtttgctctaggctgtgcagggaaatgaattgcaggtgtctgttttcaattccctgtgctggaatccctggtgctgtctgtgccaagcacactcagctggcattgtatttgtgtgaacagacagtaactgcttagaaaggcttgaaactgtcttcacttcaaggcaaggatttccagcataaaaataaattcattcactggagaaa

SEQ ID NO: 1452 - DNA, 4751 bp, Homo sapiens
ggaagtggaggcggttggtggggttggcggggctcagcgacgctgcgcgggtggcggtttgcgaactgcgggtggactgtgtagtgaccggcgtcccgctgtctcgccccgtggcgggtgagcgagggtgcgtggtgcgcggcggcggcggaacgaacgcggtgcgggcggggcgcccgccgcagggcccatggcctcctgcgcgagcatcgacatcgaggacgccacgcagcacctgcgggacatcctcaagctggaccggcccgcgggcggccccagtgcagagagcccacggccatccagtgcctacaatggggacctcaatggacttctggtcccagacccgctctgctcaggtgatagtacctcagcaaacaagactggtcttcggaccatgccacccattaacctgcaagagaagcaggtcatctgtctctcaggagatgatagctccacctgcattgggattttggccaaggaggtggagattgtggctagcagtgactctagcatttcaagcaaggcccggggaagcaacaaggtgaaaattcagcctgtcgccaagtatgactgggaacagaagtactactatggcaacctgattgctgtgtctaactccttcttggcctatgccattcgggctgccaacaatggctctgccatggtgcgggtgatcagcgtcagcacttcggagcggaccttgctcaagggcttcacaggcagtgtggctgatctggctttcgcgcacctcaactctccacagctggcctgcctggatgaggcaggcaacctgttcgtgtggcgcttggctctggttaatggcaaaattcaagaagagatcttggtccatattcggcagccagagggcacgccactgaaccactttcgcaggatcatctggtgccccttcatccctgaggagagcgaagactgctgtgaggagagcagcccaacagtggccctgctgcatgaagaccgggctgaggtgtgggacctggacatgctccgctccagccacagtacctggcctgtggatgttagccagatcaagcagggcttcattgtggtaaaaggtcatagcacgtgcctcagtgaaggagccctctctcctgatgggactgtgctggctactgcgagccacgatggctatgtcaagttctggcagatctacattgaggggcaagatgagccaaggtgtctgcacgagtggaaacctcatgatgggcggcccctctcctgcctcctgttctgtgacaaccataagaaacaagaccctgatgtccctttctggaggttccttattactggtgctgaccagaaccgagagttaaagatgtggtgtacagtatcctggacctgcctgcagactattcgcttctccccagatatcttcagctcagtgagtgtgccccctagcctcaaggtttgcttggacctctcagcagaatacctgattctcagcgatgtgcaacggaaggtcctctatgtgatggagctgctgcaaaaccaggaggagggccacgcctgcttcagctccatctcggagttcctgctcacccaccctgtgctgagctttggtatccaggttgtgagtcgctgccggctacggcacactgaggtgctgcctgccgaagaggaaaatgacagcctgggtgctgatggtacccatggagccggtgccatggagtctgcggccggtgtgctcatcaagctcttttgtgtgcatactaaggcactgcaagatgtgcagatccgcttccagccacagctgaaccctgatgtggtggccccactgcccacccacactgcccacgaggacttcacatttggagagtctcggcccgaactgggctctgagggcctggggtcagccgctcacggctcccagcctgacctccgacgaatcgtggagctgcctgcacctgccgacttcctcagtctgagcagtgagaccaagcccaagttgatgacacctgacgccttcatgacacctagcgcctccttgcagcagatcactgcctctcccagcagcagcagcagcggtagcagcagcagcagcagcagtagcagcagctcccttacagctgtgtctgccatgagcagcacctcagctgtggacccctccttgaccaggccacctgaggagctgaccttgagccccaagctgcagctggatggcagcctgacaatgagcagcagtggcagccttcaggcaagcccgcgtggcctcctgcctggcctgctcccagccccagctgacaaactgactcccaaggggccgggccaggtgcctactgccacctctgcactgtccctggagctgcaggaagtggagcccctggggctaccccaagcctcccctagccgcactcgttcccctgatgtcatctcctcagcttccactgccctgtcccaggacatccctgagattgcatctgaggccctgtcccgtggttttggctcctctgcaccagagggccttgagccagacagtatggcttcagccgcctcggcactgcacctgctgtccccacggccccggccagggcccgagctcggcccccagctcgggcttgatggaggccctggggatggagatcggcataataccccctccctcctggaggcagccttgacccaggaggcctcgactcctgacagtcaggtttggcccacagcacctgacattactcgtgagacctgcagcaccctggcagaaagccccaggaatggccttcaggaaaagcacaagagcctggccttccaccgaccaccatatcacctgctgcagcaacgtgacagccaggatgccagtgctgagcaaagtgaccatgatgatgaggtggccagccttgcctctgcttcaggaggctttggcaccaaagttcctgctccacggctgcctgccaaggactggaagaccaagggatcccctcgaacctcacccaagctcaagaggaaaagcaagaaggatgatggggatgcagccatgggatcccggctcacagagcaccaggtggcagagccccctgaggactggccagcactaatttggcaacagcagagagagctggcagagctgcggcacagccaggaagagctgctgcagcgtctgtgtacccaactcgaaggcctgcagagcacagtcacaggccacgtagaacgtgcccttgagactcggcacgagcaggaacagcggcggctggagcgagcactggctgaggggcagcagcggggagggcagctgcaggagcagctgacacaacagttgtcccaagcactgtcgtcagctgtagctgggcggctagagcgcagcatacgggatgagatcaagaagacagtccctccatgtgtctcaaggagtctggagcctatggcaggccaactgagcaactcagtggctaccaagctcacagctgtggagggcagcatgaaagagaacatctccaagctgctcaagtccaagaacttgactgatgccatcgcccgagcagctgcagacacattacaagggccgatgcaggctgcctaccgggaagccttccagagtgtggtgctgccggcctttgagaagagctgccaggccatgttccagcaaatcaatgatagcttccggctggggacacaggaatacttgcagcagctagaaagccacatgaagagccggaaggcacgggaacaggaggccagggagcctgtgctagcccagctgcggggcctggtcagcacactgcagagtgccactgagcagatggcagccaccgtggccggcagtgttcgtgctgaggtgcagcaccagctgcatgtggctgtgggcagcctgcaggagtccattttagcacaggtacagcgcatcgttaagggtgaggtgagtgtggcgctcaaggagcagcaggccgccgtcacctccagcatcatgcaggccatgcgctcagctgctggcacacctgtcccctctgcccaccttgactgccaggcccagcaagcccatatcctgcagctgctgcagcagggccacctcaatcaggccttccagcaggcgctgacagctgctgacctgaacctggtgctgtatgtgtgtgaaactgtggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttggaataaaatgga

SEQ ID NO: 1453 - DNA, 613 bp, Homo sapiens
atggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcattgggatgctgtctatgagagagaactgcaaactttccgagaatatggagatacaggtgaaatctggtttggagaagagagtatgaatcgactaataaggtggatgcagaaacacaagattccactggatgcttcagtgcttgatattggaactggaaatggtgttttcctggttgaacttgcaaaatttggtttctctaatattactggaattgattactctccttctgcaattcagctttctggaagtattatagaaaaagaaggtttatctaacattaagttaaaggtagaagactttttgaatctctccacacagctgtctggatttcatatttgtattgacaaagggacttttgatgccataagccttaatcctgacaatgcaattgagaagaggaagcaatatgtgaaatctctctccagggtgttgaaagtaaaaggcttttttaataacgtcatgtaa

SEQ ID NO: 1454 - DNA, 7673 bp, Homo sapiens
gcgggtcgttagctgtcagagccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcagggactttctccctcgagggtcgggcattgtaacaagacgacctcttgtgctgcagcttgttacttctaaagcagaatatgccgagtttctacattgcaaaggaaagaaatttacagattttgatgaagttcgccttgagattgaagcagaaacagatcgcgtgactggaatgaataaaggcatttcctccatacccattaatttacgagtctattccccacacgtgttaaatctaacccttattgatctacctggaataactaaagtgcctgtgggagatcagccaccagatatcgagtatcagatcagagaaatgattatgcagttcatcacgagggagaactgtctgattttagctgttactccagccaacactgatcttgcaaactcagatgcgctgaagctagctaaagaagttgatcctcaaggtctgagaaccattggagttatcaccaaactggaccttatggatgaaggaacggatgccagggatgttctagagaacaaactgttgcctcttcgcaggggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagatggttcagcaatttgctgtggactttgagaagagaattgaagggtcaggggatcaagtagataccctggaactctcaggtggtgctaaaatcaatcgtatttttcatgaacgctttccttttgagatagtaaagatggagttcaatgagaaagaattgcgaagagaaataagctatgcaatcaaaaacatacatggtatcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaactggcaaacttccccagactctgcgaggaaacggaaaggattgttgctaaccacattcgtgagcgagaagggaagacaaaggaccaggtattgctattgattgacattcaagtctcttacatcaacaccaaccatgaagacttcattggcttcgcaaatgctcagcagaggagcagtcaggttcacaagaaaaccacagttggaaatcagggaaccaatcttccgccttcaaggcaaattgtgattcgcaaggggtggctcaccatcagcaacattggcatcatgaaaggcggctcgaagggatactggttcgtccttactgcggaaagcttgtcctggtataaagatgatgaggaaaaagaaaagaagtacatgcttcccttggacaacctgaaagttcgggatgtggaaaagagctttatgtctagcaagcacatctttgcactctttaatacagagcaaaggaatgtatacaaagactatcgcttccttgagctggcatgtgattcccaggaggatgtcgacagctggaaggcatctctactaagagctggggtctatcctgacaaatctgtaatgaacaaaaaagctgaaaatgatgagaatggacaagcagaaaacttttccatggacccacaattggagaggcaagtggagaccattcgcaacctcgtagactcctacatgtccattatcaacaaatgtatccgagatctaattccaaaaacaataatgcaccttatgatcaataacgttaaagatttcataaattccgagctcctagcacagttgtattcttcagaggaccaaaataccctgatggaggaatctgctgagcaggctcagcgccgggatgagatgcttcgaatgtatcaagcactgaaagaagcccttgggataattggggacatcagcacagccaccgtgtccactccggcaccccctccagtggatgactcctggatacagcactctcgcaggtcacctcctccaagccccacaacccaaaggaggccaacactaagtgctcccctcgcaaggcccacatccggccgaggaccagctcctgccattccctctcctggcccccactctggggctcctccagtcccattccgtccaggcccattacctcctttccccagcagcagtgactccttcggagcccctccacaagttccatctaggcctacgagggccccgcccagtgtcccaagccggagaccacccccatcaccaactcgtcccactataatccgcccactagaatcctccctgttagactaaacgaagtgtctggcatggcaattaatcactaatgaattatgcgaaagcaacatatttgataaccgttgcagtaaatcatgagtagtcgcatgtgtggacatcagtaggcaagtaaccagttttactaatgcattcatcgctcatcttcattgctcatggtatgtcaaacctttggggtttgactcagaaactgctaaccttttagaggctttatatgttgtactgaccaaggtaggtttgtatagcagccctatactttggggatcatttgcctaccatggcatatatttgaaattgctttggacaagttttctaggctatctaccaggtagctcattaaacgtaattcttcagatatgagatagtgggcttagacctaagccatacatatttcttttcccacattctgtttaggatgacagtaattctgttgtctaccattaatgctactacctactccataattgcctatttagctcctcttttcttcctttttatttcataagactgctaggaagtgattttttaaaattaggactccttaagaataaacttttccagaagcacgaggtagtttgcaaaggaaaagtctgcactgtttgctctaaagagcttctcctcattccaatgtgttttgcttcatgctagaagcatatgcaacagtgaataaaagcttctttttttgttaatcagtcaataaatttggctaattagtttcagagttcaaggaagaagcaaaatatcacatctctagaagtgttgggaaaaatataatttctttctttacttatattcacctcatggtaggttatattgaaggctgacatggagaatgtttacttttctatttggcatagctaactacactttgatactaactccagttttactattattattttggttggaaaaaaaattcactctttacgtgctaatttgtaatcttgttttgtaagaatttatcctacccttgaaacaggctcagtgtaactgtatatccattctaggctttcttaataaatcttgaggctatgggataatcacatttaaagaatggttcctgaaatgaagtcagtagaaatggcatgggataagagcagagctcacacttttacagttgcagtatttcaaagtccctatccaggtcactccagaaaagggtattgaaacgttgaaatctaaagcaaatttgcaatttcttaagatttctaaaatttaccagaacagtttagcctgggggttaatagttaagtcttgaggctaagttttggactaccaaggaccagatgattcacatgtaggaaacagccagaagccaactggaattttgtgtgctaactgttcccagacagcagagcaagtattcactgagtaggggtgtcccatgacactatttcatattctacagaagtaaatcaggtttcaccaactgaaatgtctccctttgaaagtagcaaacatgatttgtatgttaacttaactttaatttcctgtgtagtttacacccagagcagatactcataaagtataaagtaaaaacttttaaccattattaaacagagaacttgccatgttgagtgccattgtattgaacttattctaaaggcttatgctaacccatttataattggtaaaaatcagaaaatacaagatttacataaaggtcatttcaacttttaaggttaccagtgattgtataaaaacatcacaatcctaaatcctctcgtatctcaccccaaaccccaaactgggggaaaaaaagttaactctttgtgaatggaaccaatgtgcaagatacatactgcatttttaaaatagtgtctcagctaaatggaaaactgttaagcaaacatccatagtaaaacaaataatcttcagtgagatctttttataaaacttcttgtttttaggattccctttgcttcttcctttgaattctctaaaataggcagctaacggattatatacttcagggtttggctttgtgctaaatgtggttttgtgttttgctgtatttcaaaattttccttctgttaaaggaaaatattgtgaataaccactggtgtgttcttagatcagcacaaaccatgtcaaaaaaaattggagatttttttccaattttccttccactgatcttaggcagtaataaacaatggcatttgtcatctttggcacttgcttttagattatagtcccacagttgcactgccccaattgtctacctttgtgggtacatttttgttctttactcctaagttatttctcatagaacccagcctactctagaatttcagcagtgacattggagaatatttttaatttgctgcagtactatgtcatattattagtatgaatctcatttcccaaagggtttgtattctgctaaaaggagatgccaatgttgaatgaagtctgaaactctagtatgtgcatagtttgacgtgcagcatgcacaccaggccttaagatgggaatgtagcttaatgattttctgtttcccataccatttctaatcttttgtgtaattttctcttaactgattgctctgatattgtaaacacaatagatgtagctctatcatgtctagcataatttaaaaaatcagtgtttttaggatttgggaaaataaactgtaaatgtttatttgataggtaaatatagttttattgtcacatgctaaatattgcatgcatattgactaattggaataaccatttactcaattatggacagcttattgaaatagtattgatttagaaaaagtatattgcatttctaaaaaacatctaccaaggttactcgtctgaatattgcttttagccgtgttttataacatagacgagcagtagggtctgtttattagcaaatttcctatttgttccaatacaaactcactttattctaaagtatattaatgaaaccagttcctgtgatgtaactgtaagccttctcgacttagacttaaaaagtggtcacatagattaattttgtgactttttagtatagactgtagccataattctcaaatatgaaatgggacctaataccagtatgtgataaatgttgatgttttctgtgtacaaacacattttctatgcatgtgtctctgtgtatatggcatatacctagtaagtatgtttctgtaagtatgtgtattttatgtccatttgagtaggtaggtaggttttaaaaatactagttaaaatgccacaagcatgagtgtgattgtatgtgcactgtgtgtatatatataaatatatgtatatgtatggttgtaaatatctatgtatacatgtacttagtatgtgtggtatcaggatattttttaaactgtgataatacaacagatagctttgaatgatctgccataacatgtggtaacaatagttcatttctcataacatatatgaggtatacaaaattttctaactccagattgtagtcattttgagaggtacaaagctcataattaccatgacaacatggtaatgtccatagacatttgtatctgaatccacaagaagatctgaatctaagaaggaattacctttgacaatatttttcggtaagaagtaaaacctctggagacctatctttaagatctctaattggaattataaattatttttggattgctgagctgaatcttaaaaagccaagttgatatacatagtcatttttcctctatggtagaagtaaaaaaaaaaaaaaaggacatagcaacattaaagtagtggatttttctgagtaaatttgctgaaaatataagagagaagctatctaataccttggaggtaggtcatccactttttcaggtaaacatttttcatttggcaaatggcataattatttgaaagtgacaggaatctcctcagaatgaagaataaagcctactaggtctctaactgttgaactcatgaaagaagatagtgtatgagacttaagccatgagttttgtatcatttcaattagaagactactagctgtgagctcagagtttaatgtaaatgaatctagatgattttgaagaaatgattattcgttcaccagatcactcattgtacattctaaaaagctcaaatgagtcttctagatactcttactcatcctgtctggttgctatgtttaaaattatgtggtgctgtgtaggtgaaactttaagaatatttttgaagcatatgtaatatatgcactgctatttgtgtgtgtgtgtgtgtctttgtatatatgtaagaatgtgtgtatgtgtgagagcaagagagaggaaactcaaagaggagtgtttgtcttaagacctgttcatactggtatattggtgagacttctcacttctggttggaggtttcacatatggctcaactcaagtcattaatctctttttaatttttactcttgaattccttaaacttcgctcattatgaaatgttttaaaattatgacaaaaattactctgtctaaccacttgccttgtctgctaccagtttgttaaaaattattccccccaaccagtaattccaccagtactacttgatttgtgttatatttcctatgtacatgtacagcctttgttttgcttgcttgtctatttttactttcccttttttgggtcaaatttttcttttgctttgtttgaagaaggaatatacagaagtaaaatcttgtcttctctgctgattctttaattaatatgagccggatactttccactgtcttcttggcactttcaggatttcttaatgctgatatatggactcttagaatggaatttttgaagaaaaatctcaaagcctgtatcgttcttgaaggtcacatgtacctattgtgaaaatgtgaagctgtatttctgaagctgaaataaattataacatttgaagg

SEQ ID NO: 1455 - DNA, 6379 bp, Homo sapiens
gccacagggacagccggtgggctcggtggggctgcagaaggtcggggctgcactgctctcggcccccacacggttggttggttggcgtggtaagtgccctgatccctggtcctgagaactcaggctggcacagggattcccagggcatctaccaccacgcagctggagcagggctgagcccaggagcatggagatggacgcccccaggccccccagtcttgctgtccctggagcagcatcgaggcccgggagggctgccatcagcagcagtgagccatcacctctgctggccacattgtgttttttctcctagaactgtggacaacggaaggctgagccccatccattgagttcctggggccccactggaggggctgctgtggccagggtgcacggtcacaaatgaagacaccaaggcgcagagaggtgactcagcctgccctcagtcacctatctgctcctggaggtgatccccgactccatgaggaagcaagaggtgcggacgggcagggaggccggccagggccacggtacgggctccccagccgagcaggtgaaagccctcatggatctgctggctgggaagggcagtcaaggctcccaggccccgcaggccctggataggacaccggatgccccgctggggccctgcagcaatgactcaaggatacagaggcaccgcaaggccctgctgagcaaggtgggaggtggcccggagctgggcggaccctggcacaggctggcctccctcctgctggtggagggcctgacggacctgcagctgagggaacacgacttcacacaggtggaggccacccgcgggggcgggcaccccgccaggaccgtcgccctggaccggctcttcctgcctctctcccgggtgtctgtcccaccccgggtctccatcactatcggggtggccggcatgggcaagaccaccctggtgaggcacttcgtccgcctctgggcccatgggcaggtcggcaaggacttctcgctggtgctgcctctgaccttccgggatctcaacacccacgagaagctgtgtgccgaccgactcatctgctcggtcttcccgcacgtcggggagcccagcctggcggtggcagtcccagccagggccctcctgatcctggacggcttggatgagtgcaggacgcctctggacttctccaacaccgtggcctgcacggacccaaagaaggagatcccggtggaccacctgatcaccaacatcatccgtggcaacctctttccggaagtttccatctggatcacctcccgtcccagtgcatctggccagatcccagggggcctggtggaccggatgacggagatccggggctttaacgaggaggagatcaaggtgtgtttggagcagatgttccccgaggaccaggcccttctgggctggatgctgagccaagtgcaggctgacagggccctgtacctgatgtgcaccgtcccagccttctgcaggctcacggggatggcgctaggccacctgtggcgcagcaggacggggccccaggatgcagagctgtggcccccgaggaccctgtgcgagctctactcatggtactttaggatggccctcagcggggaggggcaggagaagggcaaggcaagccctcgcatcgagcaggtggcccatggtggccgcaagatggtggggacattgggccgtctggccttccatgggctgctcaagaagaaatacgtgttttacgagcaagacatgaaggcgtttggtgtagacctcgctctgctgcagggcgccccgtgcagctgcttcctgcagagagaggagacgttggcatcgtcagtggcctactgcttcacccacctgtccctgcaggagtttgtggcagccgcgtattactatggcgcatccaggagggccatcttcgacctcttcactgagagcggcgtatcctggcccaggctgggcttcctcacgcatttcaggagcgcagcccagcgggccatgcaggcagaggacgggaggctggacgtgttcctgcgcttcctctccggcctcttgtctccgagggtcaatgccctcctggccggctccctgctggcccaaggcgagcaccaggcctaccggacccaggtggctgagctcctgcagggctgcctgcgccccgatgccgcagtctgtgcacgggccatcaacgtgttgcactgcctgcatgagctgcagcacaccgagctggcccgcagcgtggaggaggccatggagagcggggccctggccaggctgactggtcccgcgcaccgcgctgccctggcctacctcctgcaggtgtccgacgcctgtgcccaggaggccaacctgtccctgagcctcagccagggcgtccttcagagcctgctgccccagctgctctactgccggaagctcaggctggacaccaaccagttccaggaccccgtgatggagctgctgggcagcgtgctgagtgggaaggactgtcgcattcagaagatcagcttggcggagaaccagatcagtaacaaaggggccaaagctctggccagatccctcttggtcaacagaagtctgacctctctggacctccgcggtaactccattggaccacaaggggccaaggcgctggcagacgctttgaagatcaaccgcaccctgacctccctgagcctccagggcaacaccgttagggatgatggtgccaggtccatggctgaggccttggcctccaaccggaccctctccatgctgcacctgcagaagaacagcatcgggcccatgggagcccagcggatggcagatttgaagcagaacaggagtctgaaagagctcatgttctccagtaatagtattggtgatggaggtgccaaggccctggctgaggccctgaaggtgaaccagggcctggagagcctggacctgcagagcaattccatcagtgacgcaggagtggcagcactgatgggggccctctgcaccaaccagaccctcctcagcctcagccttcgagaaaactccatcagtcccgagggagcccaggccatcgctcatgccctctgcgccaacagcaccctgaagaacctggacctgcagtggaacttcatccaggccggcgctgcccaggccctgggacaagcactacagctcaacaggagcctcaccagcttagatttacaggagaacgccatcggggatgacggagcgtgtgcggtggcccgtgcactgaaggtcaacacagccctcactgctctctatctccaggtggcctcaattggtgcttcaggcgcccaggtgctaggggaagccttggctgtgaacagaaccttggagattctcgacttaagaggaaatgccattggggtggctggagccaaagccctggcaaatgctctgaaggtaaactcaagtctccggagactcaatcttcaagagaattctctggggatggacggggcgatatgcattgccacagcactgtctggaaaccacaggctccagcatatcaatctccagggaaaccacattggggactccggggccaggatgatctcagaggccatcaagacaaatgctcccacgtgcactgttgaaatgtgatcctggtggacggatcaggagaatgggcagatgctcagctggaagcttttgaacagaaaggccgacttctggggggcctgtctgggagctgggaacgctgcttgctcagcacgagagccgggctctgcagggaggaaggagaggtgctgccggaggaggtcgtgagctcctcttctgctgcaggagtggtccaggcagggggtgacgggtactctgttatggcacagagaagggaggggccacccccaagggactaggggccaaaggcctgaaagctgagcagtacaggaggctggttccagctttacaccctgaggacttcatgtgtccccaacctttaaaaatgtttattactgcccctttccactcacctggttaaaaatcatcccatgctctgagatgagctgccacctcaagcccgtgaggagcatccgtttggtaggggtaacagaggggacccttctttatcttctcaagaagaagatttcagggtatcatccttacagacatgaaaaagctatgggaaaattgtgaagataaatgaaagttttaattctaggattctggaaacagagacagtaagagttctccaaggattttgccttttttgtttgtttttgagatggagtctcgctcttgtcgcccaggctggagtgcagtggcacgatctcagctccctgcaacctccgcctcccgggttcatgtgattctcctgcctcagcctccccagtagctgggaatacaggcacccgccaccatgcccggctaatttttgtagttttagtagagacggggtttcatcatgttggccaggctggtctcgaactcctgacctcaggtgatccatcagcctgggcctcccaaagtactgggattacaggcatgagccaccacacctggccccattttttatttattacaaaatcaaagacatgggtgatgcctggcacatgttgtctggagtctggcacactggttatcaatagcacattcagtgtattcagtgatgtcattctttatttatttttgagacagaatctgtcacccaggctggagtgcagtggcatgatctcagctcactgtaggctctacctcatgggttccagtgattctcctgcctcggcctcccaagtagttgggtctacaggcacgcaccaccacacccagctaatttttgtatttttagtagagatggggtttcaccatgttgatcaggctggtctttaactcctgacctcaagtgatccacccacctcagcctcccaaagtgctgggattacaggtgtgagccactgcacctggcagtgatgtcattccttactaggcttccaaagccactgctgtggccacagcttccatggagacaggcaagctgagcctctatgtggcaccaattcctgcagctgtttgtgttggagggaaaaaaatccaaatggacatcaacagctttcatcaactaaataaccacagaaaatatttatgaagactataaagcaatgattacttttgaattggaaaggaatcactattatttgaaatgtttcttcaaaagtgagcatccggacaggaaccatcatggatgctgaggccatggatgaaggcctactcgggaagatgatatccttgcagtctcaaaacggcaccccacaaaggtgatatcctaatttacaaagggaaaaaggtaccttaatctgaaatctggcaaatgcagcctcaacagaagtgacagaattgaacatcgccaataatgggacacacagacatcacatgcccccagtctgatgcaccacggagtcgtctctgatgtattcttgtcaaaaaatgtttgcctgattctaatcatgaaagaacaattagaaaaaatccaaattgacagatattctgcagaataaatggcctgacctcatcaaaaacatcaatgtcatgaaaaacacaaaacattgcagatagcgtgaaattaaagattacagagatataatttaatgcaagatctctgactggatcctagactgcaggaaaaagtctgctataaagaacatttggatcacttgtagtagctgggaaataaaacaaaacattatttgtaaaaggggggaaatctgaacatgggtcttgcagtatttatgacagtttttgcggggcagagatttctagattgacagctgttttagtactttcaaggtgatgctctgtctgctggtttgcattgtttctgtctgagttaagagactggcagaacacagagttgcagtagccaaacactggagaaagctgggccctacagaaacctaacgctgaagaaacctcaggagccaaactggtggagaaaacaaagagtcctccctctctcccttttcaaataatgatcatacatcttcaagctgtctgaaatggttaaggagttcagtctgtcgtcaggcacacaccagagccagctagcccacacagaccccatcagagcaaaacagacaagagaatttaattcatatccacatagaaaggacttctaggtaggaggtagaccctttagctcccttccaattaaaggagtccccaattctggcacctgagagtcccctgggtctaacagctatgatatttatgtagtgtgttgcttacctaaatgaatacaatttccttccagacacgtgacactgatattaaagtgctaatgagagggatctatttcttcttgtacgctaaaagagaaacagcagttcagatttcccatcagaagtccgaggactttgttcttgataactactaccaataaaaattgagtatttg

SEQ ID NO: 1456 - DNA, 4030 bp, Homo sapiens
ggagcgcgtgcccgtgcgccgccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaccaccattggtgtgctggaggagcccctggggaatgcccgtctgcatggcgcccgcctcatggcagcactgctgcacacaaacacacccagcatcaaccaggagctctgccggctcaacacgatggacttactgctggacttgttctttaagtacacctggaataactttttgcacttccaagtggaactatgcatagccgctattctctcccacgctgcccgtgaggagaggacagaagccagcggatccgagagcagggtggagcctccgcatgagaacgggaaccggagcctggagactccccagccggccgccagcctccctgacaacacaatggtgacccacctgttccagaagtgctgcctggtgcagaggatcctggaggcctgggaagccaacgaccacacgcaggcagcgggtggcatgagacgtgggaacatgggccacctcacacggatcgccaacgcggtggtgcagaacctggagcggggccctgtgcagacgcacatcagcgaggtcatccgagggctccctgcggactgccgtggccgctgggagagcttcgtggaggagacgctgacggagacgaaccgcaggaacactgtggacctggccttctctgactaccagatccagcagatgacagccaacttcgtggatcagtttggcttcaatgatgaggagtttgccgaccaggacgacaacatcaatgccccgtttgacaggatcgcagagatcaacttcaacatcgacgctgacgaggacagtcccagcgcagctctgtttgaggcctgctgcagtgaccgcatccagccctttgatgatgatgaggacgaggacatctgggaggacagtgacactcgctgtgctgcccgggtgatggccagacccaggtttggagccccccatgcttcagagagttgctcaaagaatggcccagagcgtggaggccaggatgggaaggcgagcttggaagcacacagagatgcacctggggcaggtgccccaccggcccccgggaagaaggaagcgccccctgtggagggtgactcagaagcaggcgccatgtggacggcagtgtttgatgagccagcgaactcaacgcccacagccccaggagtggtgagggacgtgggttccagtgtgtgggcagctggcacctcagctccagaggagaaaggctgggccaagttcactgacttccaacctttctgctgctccgagtcagggcccaggtgcagctctccggtggacacagaatgcagccatgctgagggcagccggagccaaggccctgagaaagccttcagcccggcttctccatgtgcctggaacgtgtgtgtcaccaggaaggcccccctgctggcctctgacagtagctcctctgggggctcccacagcgaggatggcgaccagaaggcagcgagtgccatggatgcggtgagcaggggtcccggccgggaggcccccccgctgcccacagtggccaggacagaggaggctgtcggcagggtcgggtgtgctgacagccggctgttaagccctgcctgccccgcgccaaaggaagtgactgctgccccagccgtggctgtgccccccgaggctactgtggccatcaccacagcactgagcaaggctggccccgccatacccaccccagcagtctcttctgcactggccgtggcggtccccctagggcccatcatggcagtcacagcagccccagccatggtggccaccctggggacagtgacaaaggacggacagatgccccgccagaaggagctgccttaaatggcccagtgtgatgctgctgccgcccggccacggcccaccctggtcaggctgcctccttaatcgagaaaactacctggtgatgcaatcttttttttttttaatttaatttaattttaaaataaatgctgcattggtaaagctggcagttgaaaccagttggacggcccagcttgcgtctcttctgcctgagtgggcctctcaggtcactcgtgccctgctggaggacagaggggcacctcagccgcccccaagcccagagcacagcaataaggtcggcctgcaggagccggggtgggggtgggggtggggggggcaggaccctgagatgccaccaggacctgatgggccaggaagggcgtggacatggaggctgtttttacagttttttttttgttgttgttttgtttttaaagaatacagaaggagccaagcttttttgcactttgtatccagctgcaagctcagggcagagtcaagggcctgggttggaaaaacctgactcacaggaatgcataattgacccttgcagctacccaatagcccttggagctggcactgaaccaggctgcaagatttgactgccttaaaaacacaaggccctctaggcctggcagggatgtccctgtgcccagcacagggtgcctggcagggggagaccacaggtatgcaggtggggggacatggtgtggcactaggggctcgaagactggtttctagcactaccggtcacggccatgtcgtcctagaagggtccagaagattattttacgttgagtccatttttaatgttctgatcacctgacagggcaccccaaacccccaactcccaataaaagccgtgacgttcgg

SEQ ID NO: 1457 - DNA, 2690 bp, Homo sapiens
gtagggtgggggtgctggcggcggctgctttggcggcggttggtggccgtgcgggcggggagggagggggaggagagaagaggaggtggagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttca

SEQ ID NO: 1458 - DNA, 5723 bp, Homo sapiens
cggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggccttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctgcctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtgatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaatatgaaaatgaaactctgaatcttgagaatacaaaattaaagcttagattcccatgtagaattactgagtcaaagaatatgaacattttgattgttcttgatatgctttgctacatttcttctgaaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagagtatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagaacaaaatcaacttgtttgcaaaatgaacagtgatccagagactccatgaaatctatttttttaattcccaagtgtctaaaaagttgaaaacctaaaagattcaagagttaaatgatttttggcatgcacaatttgattttattgccatcaaaagtttcatgacaacttagtcagaacaaaacgtcgatcacctttaatttagcacaggccttccatttatttctaaacttttttttaactcaccatttgactttctgatattgtaaaatgtgtgtgctgtttttttgtgtaattgaagcctctgaaaaaataaatgaggtgggttttgctgtaatgtccctagtacttggctaaagctagtaaaataaatagatcccattcacaattgccacaaagagaataaaatacctaggaatccaaattacaaggaatgtgaaggacctcttcaaggagaactacaaaccactgcttaaggaaataagagaggacacaaacaaatggaaaacattccatgcttatgaataagatgaaacaagatcatgaaaatggctatactccccaaagtaatttatagattcagtgctatccccatcaagctaccattgactttcttcacagaattagaaaaaactacttcaaatttcatatggaaccaaaaaagagctcacataaccaagacaatcctaagcaaaaagaacaaagctgtaggcatcacgctacctgacttcaaactatactacaaggctacagtaaccaaaatagcatggtactggtgccaaaacagatatatagaccaatggaacagaacagaggcctcagaaataactccacacatctacaaccatctgctgtttgacatacctgagaaaaacaagaaatggggaaaggattccctatttaataaatggtgttgggaaaactggctagccatatgcagaaaactgaaactggatcccttccttacaccttatacaaaaattaactcaagatggattaaagacttaagtgtaagacctaaaaccataaaaaccctagaggaaaacctaggcaataccattcaggacataggcatggacgaatacttcatgactaaaacaccaaaagtaatggcaataaaagccaagattgacaaatgggatctaattaaactaaagagcttctgcacagcaaaagaaactatcatcagagtgaacaggaaccgacagaatgggagaaaatttttgcaatctatccatctgacaaagggccaatatccagaatctacaaagaacttaaacaaatttacaagaaaaaaaaccccatcaaaaagtgtgcaaagaatatgaacagacacttctcaagagaagacatttagtcagccaaaaaacatatgaaaaaaagctcatcactggtcattcagagaaatgcaaatcaaaactacagtgagataccatgtcacaccaattagaatggtgatcattaaaaagacaggaaacaacagatgctggagaggatgtggagaaataggatgcttttacactgttggtgggagtgtaaattagttcaaccactgcggaagacagtgtggcgattcctcaaggatctagaaccagaaataccatttgacccagcaatcccattactgggtatatacccaaaggactataaatcatgctgctatagagacacatgcacacgtatatttattgtggcactattcacaatagcaaagacttggagccaacccaaatgcccatcaatgatagactgaataaagaaaatgtggcacatacaccatggaatactatgcagccataaaaaaggatgagttcatgtcctttgcagggacatggatgaagctggaaaccatcattctcagcaaactaacacaagaacagaaaaccaaacaccgcatgttctcactcataagtgggagttgaacaatgagaatacatggatacagggcagggaacatcacacaccagggcctgtcagggcgtggggggctaggggagggataacattagaaattcctaatgtagatgacgggttgatgagtgcagcaaaccaccatggcacgtgtatacctatgtaaccaacctgtacgttctgtacatgtatcccagaacttaaagtataataaaaattaaaaaaaataaagatctgatgttttgttaaacctgataagttttgtactagtaaaattctagaattctaagcatagatttaaacattgctgaaaaatgagtttgtgtgttttatgccttccaggggacagttaagtgggcagtatttatttaatatacctgcttcagccccatttgaattgtaagcactctgaaagcatgtctcatagtcgtctgtatccctggtgtctcccacagtgccctgcttacctgcaggcctttttgtattttctgtccaagtaccctaatagggtggtgcagaatggatgtacagatctgtggatgacctcagcagcttaatccaaggcacccctcgggaagcctgaaatgtctttgaagtcttatgtattatcctaaaatccattgacattttatattctaccctacaaaataagtatgtgttactatttttctttccaaattgttgagtaaaactcattgtattcatcctgtgactttgtactgcccagcctagctcattgttttttacctgcctcatttcctgagctgggcattgctcagtttcagaaggtatcaggtgtcattgaacacctgatatgaaggatgtaaaagttctctcttttctatctaggtgtctatattttaattggaggctagatgatatttgcaacctgtctttatctaaagcattgtcagtgaactcacctacttaggaattcatatgcaccttagttaaaaaaaatgtattgtggttttaaattttttcctcaaccagtgtaatatgaagaattctttttattttttaagagattctaagaaaatgttcacattatcaaaactagaattctatcaacttttaagacatttaattattttggaataaaatgtgaatttttagacagaaaatggcaaaaactagtatgaaaatatatcatgttacatgtgaaattatgacagttgttaacctattaagttaatcatgttaaatatgtaataatttggggctaaatgaatgtatattataaattatatcagtgaagatcaaccatgtgtgtgctttaattattaattttaaagagtgagctctaagaatgaacacatcagatgtgagtattattttaaaaaatcaaaaagaattatctagttattgtatatatgtttttaatattatgactctggtcctttggaatgaatgctattattgcttatctgtatttttttccttttttctttagaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctctaagtagtagatttttattatgagtctaaaatgtgattgggtaaaaaaataaatatactaccagttaca

SEQ ID NO: 1459 - DNA, 1113 bp, Homo sapiens
ctcagcgaagatggcggcagtggagaagcggcggcaagcggtaccaccgccggccggtttcacggacagcggccgccagtcggtatcccgggcggcgggggcggccgagagcgaggaggacttcctgcggcaggtcggcgtgacggaaatgctacgtgcggccctgctgaaggtgctggaggcgcggcccgaggagccgatcgccttcctggctcactacttcgagaacatgggcctgcgctcgcctgtaaacggcggcgccggggagcccccgggccagctcctgctgcagcagcagcgcctgggccgcgcgctatggcaccttcgcctggcccaccactcccagagggccgccttcaacaacaacgtgagcgtggcctacgagtgcctgagcgccggcgggcgcaggaagaggccggggctggacgggcgcacctacagcgagctgctcaggcgcatctgccgggacggccaagcccccgaggaggtggtggcgccgctgctgcgcaaggtgcagtgccgtgaccacgaggcggtgccgctgagcgtcttccgcgcgggcacactcacctgcttcgtgctgctggagttcgtggcgcgcgccggcgcgctcttccagctgctggaggactcggccgccgccgtggccgaccgccgcgtgggccaggccgtgctggacaccctggagggcgcgctgcaggccagcgacgccgccgcgcccgcgcgcttcctggaggccggctcgcgcttggggcccgacagcctggcgctggcgctggaccgcgccgtcggggggcggcggcccagcgcgcccatgacccgcgaggagtttctggagagggccgccgcgctcttcatcgcgaaggtcaagccggtgggctgaggcccgtgggccgcgcggatccgggatctgcgctggggggtccccgcgtgcggggcgcgcggagccttcccttcgccctggtgaggccctgccataaccaggcgcccagccctgcggaggaggccggggctcccaggaagcggacgcccggtccccacacagcgccgcggccgcccctccacccccgcgggagcccctgccccacgctaataaaatgtgttgcgaggctg

SEQ ID NO: 1460 - DNA, 2691 bp, Homo sapiens
gttcgtgcgtggagcagtcggggctggaggcgaggccgccgggcgggcaggggttgtggcgcggcaagcggcgggccagcgacggcgcgaatggcggactctcagctgttctgtgtggcggaggaacgcagcggccactgcgccgtggtggacggaaacttcctctacgtgtgggggggctacgtgtctattgaagacaatgaagtatatttgcctaatgatgaaatttggacctatgatattgatagtgggttgtggagaatgcacctcatggaaggagaactcccagcctccatgtcaggaagctgtggtgcttgcattaatggaaagctgtacatttttggaggatatgatgacaaaggatacagcaatcgactttattttgttaatttacgaacaagagatgaaacctacatttgggagaaaatcaccgactttgaagggcaaccacctacaccacgtgataaactttcctgctgggtatataaagacagactaatatattttggtggttatgggtgtaggagacacagtgaactccaagactgttttgatgttcatgatgcatcttgggaagagcagatattctggggatggcataatgatgtccacatatttgacacaaagacacagacttggtttcaaccagaaattaaaggtggagttccaccacagccacgagccgcgcatacatgtgcagttcttggaaataagggttatatctttggcggacgtgttctgcaaactaggatgaatgatttgcactatctaaacctagacacctggacttggtctggaaggattactattaatggagaaagcccaaaacatcggtcatggcatactttaacacctatagctgatgataaacttttcctatgtggtggactaagtgcagataatatcccattaagtgatggttggattcataatgtcacaacaaattgttggaaacaacttacacatttacctaaaacaagacctaggttatggcacacagcctgtttgggaaaagaaaatgaaataatggtatttggtgggagcaaagatgacttacttgccttggatacaggtcactgtaatgatttattgatctttcaaacacagccttattcactactcaggtcatgccttgactgcattggtaaaaattctatcatgttagaaagtcagatatctttattacctcctaaacttctgcaacaagtactcaaaaaaataacattttgggctgcagctaatcaccgagaagaacaaagagtccaaaaagaagaaacagaaaataaatatcagtggatcagtagcaattaaattgttatatactttacatatttagtatgttttaactttttaatcagactatacatttacactcccaaattgcaggctttatttaaaggataaaatttaaaggataaaaaaacagtcactctgttaagtgactatatgccatgggatatatggaaaaaagatattaatgcagattaatttatatttgtaaacaaatttccttacaaactgcagaacaaatattctttctgaaagtaagtacagttataacagattttaaatcaatgtgtattctttactggaaagattacatacatttgagaataagaaattactctcaagaacttcagaaatctgcaacataattttataaatatataaatacatgtatgtatgtcaaaacactacatatacactttcagaaagaataaactttctcaagtcattttaaagttacctaacgttcttcttgaataactaatacagtgggtcaaatattataaaataggcaaacaccaaaatggtattaaatattgaactcctgaccttttcgacacttacctagtaaagtattcttaggcatcatcataacttttcctcacctttattcgaatagaggaataaatgtcttcagttgtctctccattacccctaagttattagtttgtctagtttatatataaagaccatgttttaaagtacataaagtggaggtttatttatcatacaggctttgaaacattaagaagcagtatttttattaactttttgagacatattaaaatacattttgccttagaagactgcttctaaagtaatttttgtaagtaatgagatgggatggtaatctagtaatttgactttatagaaatccctcagtttggcccccaccattctacagagttgtactcaagacagatactgaaaaaatctaataccttcccttgtattttcagcattaccatctatacagaaatggaacactgtatctttatattcctaaaaatggtacttttggcataattaagaaatttttcttcatattatcacaatcatgcccttccattgaattattaattacaattaattactaaaaagcttggtatgtaaaattattctccacaatattaccatgcaagttatctctgaaatttaaaatgttaaagaaaaacatttctatattgaaatatatataatttataatgaaaattatagtagtttgtagtatttcattgaattttagagagatatttcatatatatgtactgtattttggatgtgtaaagcttctatgtattgaaatatttttttacgttttatttattgtacaaagtgtatataattactgttttcttttttgtcagtgtaaagcagtcattagaattgattatacaaaaaata

SEQ ID NO: 1461 - DNA, 1409 bp, Homo sapiens
aacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatatagaatctgcaaactgcttcagatcaaacagggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaa

SEQ ID NO: 1462 - DNA, 787 bp, Homo sapiens
gttgcctgatgacgagagttgggagtgtggctggggctgcggatctccagcagtggcgttacttctagcggctggataccgggttctccgcgagatcgcgagatcccgagatattctccccgcacggaagcgacgactggcctggccagaggactcgcgtgggagcgaggtgccggccccgacaggacggtgagaaattgttttacagcctacccgtatattacaagaaatctcaagtcaaacactggaaaagatgtcagaagattcagaaaaggaagactattcagacagaacaatcagtgatgaagatgaatcggatgaggatatgttcatgaaatttgtaagtgaagatcttcatcggtgtgcacttttaacagctgactcttttggtgatcccttcttcccccggactacacagatactattagaatatcagctagggagatgggtgccacgtcttcgtgaaccaagggatttatatggtgtctcttcttctggtccattgagcccaacacggtggccataccattgtgaagtcatcgatgaaaaagtccagcatattgatggagtctcatgctggagtgagtctcaccaggctggagcgcagtggtgcgatctcggctcactgcaacctccacctcccaggttcaagcgattcgcctgcttcagcctcctgagtagcagagactacaggcgcgtgccaccacgctcagctaattttgtatttttagtagagacggggtttcaccatgttggccaggatggtctccgtctcttgacctcgtga

SEQ ID NO: 1463 - DNA, 2843 bp, Homo sapiens
gaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggaaaccaacatgtctgacaaaagtgacttaaaagctgagctagagcgcaaaaagcagcgcttagcacagataagagaagagaagaaacggaaggaagaggagaggaaaaagaaagaggctgatatgcagcagaagaaagaacccgttcaggacgactctgatctggatcgcaaacgacgagagacagaggctttgctgcaaagcattggtatctcaccggagccgcctctagtcccaacccctatgtctccctcctcgaaatcagtgagcactcccagtgaagctggaagccaagactcaggcgatctggggccattaacaagaagaagactgcataaactgggcgtgtcaaaggtcacccaagtggatttcctgccaagggaagtagtgtcctactcaaaggagacccagactcctcttgccacgcatcagtctgaagaggatgaggaagatgaggaaatggtggaatctaaagttggccaggactcagaactggaaaatcaggacaaaaaacaggaagtgaaggaagcccctccaagagagttgacagaggaagaaaaacagcagatccttcattcagaggaatttctcatcttttttgaccggacaatacgggtaattgaaagagccctggctgaagattccgacatcttttttgactacagcggccgagagttagaggaaaaagatggggatgttcaggctggagccaatctttctttcaatcgtcagttctatgatgaacattggtccaagcatcgagtggtcacttgtatggactggtccctccagtaccctgagctgatggtggcttcttacaacaacaatgaagatgctccccatgaaccagatggagtggccttggtttggaacatgaagtttaagaaaaccacaccagaatacgtcttccactgtcagtcctctgtgatgtcggtctgcttcgcccgtttccatcctaacttggtggttggtgggacttactcgggccagattgtcctctgggacaatcgcagtcatcgaaggactccagtgcagcggacacccttatcagctgctgcacacacgcatcccgtgtactgtgtaaatgttgttgggacccagaatgctcataacctcatcactgtctccactgatggcaaaatgtgttcctggagcctggacatgctctcaactccacaggagagcatggagctggtgtacaataagtccaagcctgtcgctgttaccggaatggctttcccaacgggagacgtcaataacttcgtggttggcagtgaggaaggtacagtctacacggcttgtcgtcatggaagcaaagcaggtattggtgaggtctttgaaggtcaccaagggccagtgacaggaattaactgccacatggcagtgggcccaatcgacttttctcacctgtttgtcacatcatcatttgactggactgtcaaactgtggaccaccaagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagcttgcagttccccacaatgatgaatggacccgatttgccaggacccttgtggaaattcgtgctaacagagctgatagcgaggaggaaggcactgttgagttatctgcctagtggaaatgagccacccccactgcagcccccacctttgtgtcctagagctcagcgtctgcagtcaagtctcttgtattcggtgtccattcagtatcagtattgctgtgatattttgggtgccatattgtgccagctttgctccaagtattctaaatgtgtcccatcatgctttccactgacccaaaattcaccacagcatttctatctttatatttctgtctcaaaaatgaagagaagggggttatgggttaagttgctgccttttaactactttgtagctgtatttaatagctggaaacctctggttaaatttgtgcttacatgcactcctggcatagtcctattaaatccatatgaagccagatatgattgggtgcagatgtggtgttcctcatattatggtacagggccaaagacttgagacgtggtgttttacatggtgactcacattatgaatggatttactagaagaacattgctgctccttatttattgtagtgtgctgcatggaacgtatttatttgaaagcattaaaataaatgatcctagagcatgtgcataatgagaggactgtattctctctgctgctgttgaggttatattaagttccacatagcaattacagtatgccagttccactgaagacatgaaatctttagaggtttcttgcagtgaacgaaatgaattttaatgcctattatttctgggtactttaacaatatttcaaatatcattgaccactaatacttctcactgaagctaacacagtctgacaaaagtctatggttcctaaatatgacatcagtgttgccaataaaatgtttcaaacca

SEQ ID NO: 1464 - DNA, 687 bp, Homo sapiens
gacatcccagcgctgtgcccggtcttgccctctgtagcccggctcgccccgcgcttggacatggaaggggccgccgcgcctgtggcgggggaccgccccgacttggggctgggggcgccgggctctccccgagaggcggtggcgggggcgactgcagccctggagcccaggaagccgcacggggtgaagcggcatcaccacaagcacaacttgaagcaccgctacgagctgcaggagaccctgggcaaaggcacctacggcaaagtcaagcgggccaccgagaggttttctggccgagtggttgctataaaatccattcgtaaggacaaaattaaggatgaacaagacatggttcacatcagacgagagattgagatcatgtcatctctcaaccatcctcatatcatcagtatttatgaagtgtttgagaacaaagataagattgtgatcatcatggaatatgccagcaaaggggagctgtacgattacatcagtgagcggcgacgcctcagtgagagggagacccggcacttcttccggcagatcgtctctgctgtgcactattgtcacaagaacggtgtggtccaccgggacttgaagctgaaaagacccagcagagagaatcaggttactactcttccccagagcgcagtgagtcttcggagctgttggacagtaatgatgtga

SEQ ID NO: 1465 - DNA, 1451 bp, Homo sapiens
ggaggcgtcggggctgcgccgtacaacttccggctgtaaagatggcggcttcctagtgagtcggcggctgatttagaaggaggttcaggctacggtgagccgaaggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaccgaagtccacgccaa

SEQ ID NO: 1466 - DNA, 913 bp, Homo sapiens
ccacctcctgccctgctggggtccagccatgtcccagcctgcgggaggcaggaggaagcccaggaccctagggccgcctgtgtgcagtatccggcctttcaagtcgagtgagcagtacctggaggccatgaaggaagacctggctgagtggcttcgcgacctctatgggctggacatcgacgcagccaacttcctgcaggtgctggaaacgggcctggtgctgtgccaacacgccaacgttgtcactgacgctgccctggccttcctggctgaggcacctgcccaagcccagaagattcccatgccccgggtcggggtctcctgcaatggggccgcccagccaggtaccttccaggccagggacaatgtctctaacttcatccagtggtgtcgaaaggagatgggcatccaagaggtgctgatgttcgagacggaggacttggtgctgcgcaagaacgtgaagaacgtggtgctgtgtttgctggagctgggccgccgggcgtggcgctttggtgttgcggcgcccacactcgtgcagctggaggaggagatcgaggaggaggtgcggcgggagctggccctgcccccacttccgcaacctggaccagatggtgcagagccttgtgagccactgcacgtgcccagtgcagttctccatggtcaaagtgtctatgtcttcctgggtccagccaggcagccccccaaggacaggctgttgagagctgtgctgggcagcaagggaggggaggcatcccgggtggatggagcttcagtaggtgaggaggaggaggaaggaaaggaggagaaagagccagccgctccattggagagcagcccccaacctccagagggcctgcaacctcactggcttaatcaagctccacttccacctgaggaggagtcctgggtctga

SEQ ID NO: 1467 - DNA, 4348 bp, Homo sapiens
cgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctctcaagctctcgcctttcctatcagcctgctgccctgggcgttggatcagctgacctggcttatccagtagtgtttgctgctggcttaaatgctacacaccctcaccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggagtcgcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgtactttacagcctcctgtcctgtaggttgtctgaagacctcgtaaccccttccccacccctgccccagtgcaggtctgggaaaggggagagtggtgcgttgtgaagcgcagaaagacctcaagtgtctgggcaagcctgttttgagtcgggtgtggcctcttaggggctgtataccctggggtttcctgggtcaggaaacttcttagtatttctctttccctggtcccctatcaggggcttgaatttgaatattcagttggagaatgcatttaaaatacacccatagtaaaatctccataaaatgca

SEQ ID NO: 1468 - DNA, 1590 bp, Homo sapiens
acagtagctcacacctgtaatcccagcactttggaaggccgaggtgggcggatcacctgagctcaggagtttgagaccagcctgtctctactaacaatataaaaattagctgggagtcacggtgggcgcctgtaatcccagctactcgggaggctgaggcaggagaattgcttgaacccaggagacagaggttgtagtgagctgagatcgcaccactgcactctagccttggcaacagtgcaagactgtctcaaaaacagcaacagagagcaggacgtgagacttctacctgctcactcagaatcatttctgcaccaaccatggccacgtttgtggagctcagtaccaaagccaagatgcccattgtgggcctgggcacttggaagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcaatgcagaatattgaggttgaatctcctggtgagattatacaggagattctctttcttcgctgaagtgtgactacctccactcatgtcccattttagccaagcttatttaagatcacagtgaacttagtcctgttatagacgagaatcgaggtgctgttttagacatttatttctgtatgttcaactaggatcagaatatcacagaaaagcatggcttgaataaggaaatgacaattttttccacttatctgatcagaacaaatgtttattaagcatcagaaactctgccaacactgaggatgtaaagatcaataaaaaaaataataatcataa
